(12) United States Patent
Milano et al.

(10) Patent No.: US 7,879,582 B2
(45) Date of Patent: Feb. 1, 2011

(54) METHOD FOR THE RECOMBINATION OF GENETIC ELEMENTS

(75) Inventors: Joseph Milano, Claymont, DE (US); Xiao-Song Tang, Hockessin, DE (US)

(73) Assignee: E. I. du Pont de Nemours and Company, Wilmington, DE (US)

(*) Notice: Subject to any disclaimer, the term of this patent is extended or adjusted under 35 U.S.C. 154(b) by 1095 days.

(21) Appl. No.: 10/374,366

(22) Filed: Feb. 26, 2003

(65) Prior Publication Data

US 2004/0014085 A1    Jan. 22, 2004

Related U.S. Application Data

(60) Provisional application No. 60/360,279, filed on Feb. 26, 2002.

(51) Int. Cl.
   C12N 15/64   (2006.01)
   C12N 15/65   (2006.01)
   C12N 15/00   (2006.01)
   C12N 15/11   (2006.01)
   C12N 15/12   (2006.01)

(52) U.S. Cl. .................... 435/91.4; 435/91.5; 435/69.1; 435/320.1; 435/183; 530/350

(58) Field of Classification Search ........................ None
See application file for complete search history.

(56) References Cited

U.S. PATENT DOCUMENTS

| | | | |
|---|---|---|---|
| 5,605,793 A | 2/1997 | Stemmer | |
| 5,811,238 A | 9/1998 | Stemmer et al. | |
| 5,830,721 A | 11/1998 | Stemmer et al. | |
| 5,837,458 A | 11/1998 | Minshull et al. | |
| 5,965,408 A | 10/1999 | Short | |
| 6,117,679 A | 9/2000 | Stemmer | |
| 6,132,970 A | 10/2000 | Stemmer | |
| 6,153,410 A | 11/2000 | Arnold et al. | |
| 6,177,263 B1 * | 1/2001 | Arnold et al. | 435/91.1 |
| 6,180,406 B1 | 1/2001 | Stemmer | |
| 6,287,861 B1 | 9/2001 | Stemmer et al. | |
| 6,291,242 B1 | 9/2001 | Stemmer | |
| 6,297,053 B1 | 10/2001 | Stemmer | |
| 6,344,356 B1 | 2/2002 | Stemmer | |
| 6,706,503 B2 * | 3/2004 | Schellenberger et al. | 435/170 |
| 2004/0053267 A1 | 3/2004 | Gibbs et al. | |

FOREIGN PATENT DOCUMENTS

WO  WO 01/11071 A2  2/2001
WO  WO 02/18629 A1  3/2002

OTHER PUBLICATIONS

Marton et al., "DNA Nicking Favors PCR Recombination", Nucleic Acids Res., 19(9):2423-2426 (1991).*
Maheshri and Schaffer, Computation and experimental analysis of DNA shuffling. PNAS, 203 vol. 100(6) 3071-3076.*
Fang et al, PCR-mediated recombination: A general method applied to construct chimeric infectious molecular clones of plasma-derived HIV-1 RNA, Nat Med. Feb. 1999;5(2):239-42.*
Hansen et al, Creation of a Fully Functional Human Chimeric DNA Repair Protein, vol. 273, No. 2, Issue of Jan. 9, pp. 756-762, 1998.*
Paabo et al., DNA Damage Promotes Jumping between Templates during Enzymatic Amplification, The Journal of Biological Chemistry, vol. 265, No. 8, Mar. 15. 1999, pp. 4718-4721.
Liu et al., Signal and noise in bridging PCR, BMC Biotechnology 2002, 2:13, pp. 1-9.
Punnonen et al., Molecular Breeding by DNA Shuffling, Science and Medicine: 7: pp. 38-47.
Minshull et al., 1999, Protein evolution by molecular breeding, Current Opinion in Chemical Biology 3: pp. 284-290.
Crameri et al., 1998, DNA shuffling of a family of genes from diverse species accelerates directed evolution. Nature 391, pp. 288-291.
Stemmer, 1994, Rapid evolution of a protein in vitro by DNA shuffling. Nature 370: pp. 389-391.
Stemmer, 1994, DNA shuffling by random fragmentation and reassembly: In vitro recombination for molecular evolution. Proceedings of the National Academy of Sciences, U.S.A. 91: pp. 10747-10751.
Pompon et al., Protein engineering by cDNA recombination in yeasts: shuffling of mammalian cytochrome P-450 functions, Gene, 1989, 83(1), pp. 15-24.
Shao et al., Random-priming in vitro recombination: an effective tool for directed evolution, Nucl. Acids Res. 26(2): 618-683, 1998.
Saiki, R.K. et al., Primer-Directed Enzymatic Amplification of DNA with a Thermostable DNA Polymerase, Science 239(4839: pp. 487-491, 1988.
Meyerhans, A. et al., DNA recombination during PCR, Nucl. Acids Res. vol. 18(7), pp. 1687-1691, 1990.
Judo, M.S.B. et al., Stimulation and suppression of PCR-mediated recombination, Nucleic Acids Res. vol. 26(7): pp. 1819-1825, 1998.
Zhao, H. et al., Molecular evolution by staggered extension process (StEP) in vitro recombination, Nat. Biotechnol. vol. 16(3): pp. 258-261, 1998.
Marton et al., DNA nicking favors PCR recombination, Nucl. Acids Res. vol. 19(9): pp. 2423.2426, 1991.
Kawarasaki et al., *A method for Functional Mapping of Protein-Protein Binding Domain by Preferential Amplification of the Shortest Amplicon Using PCR, Analytical Biochemistry* 303, pp. 34-41, 2002.
Ikeuchi et al., *Chimeric Gene Library Construciton oby a Simple and Highly Versatile Method Using Recombination—Dependent Exponential Amplificaiton, Biotechnol Prog.* 2003, 19, pp. 1460-1467.
Horton, Robert M., PCR-Mediated Recombination and Mutagenesis, Molecular Biology, 1995, pp. 93-99, vol. 3.
McPherson, M. J., Recombination and mutagenesis of DNA sequences using PCR, Directed Mutagenesis a Practical Approach, pp. 217-257, 1991, Oxford University Press.
Orum, Henrik et al., Efficient method for constructing comprehensive murine Fab antibody libraries displayed on phase, Nucleic Acids Research, 1993, pp. 4491-4498, vol. 21, No. 19, Oxford University Press.
Kikuchi, Miho et al., An effective family shuffling method using single-stranded DNA, Gene, 2000, pp. 133-137, vol. 243, Elsevier Science B.V.
Tsuji, Toru et al., Random multi-recombinant PCR for the construction of combinatorial protein libraries, Nucleic Acids Research, 2001, pp. 1-10, vol. 29, No. 20 e97, Oxford University Press.

* cited by examiner

Primary Examiner—Maria Marvich

(57) ABSTRACT

A method for the recombination of a gene is disclosed. The method involves the design of unpaired forward and reverse primers having homology to the 5' end of one template and to the 3' end of another template. Short primer extension periods results in a recombined template having paired 5' and 3' ends that can then be amplified. The amplified sample is devoid of any parental template.

45 Claims, 7 Drawing Sheets

Figure 3

Parent-1 (RM120-1): 5'-CAAGCTATACCAAGCATACAATGA............CTGCAGTCGAGGGGGGGCCCGGT-3'
SEQ ID NO:200 / SEQ ID NO:201

Parent-2 (RM492-1): 5'-TAGCTCTAGAATGGCACCCTC............CCGCTGAGCAATAACTAGC-3'
SEQ ID NO:202 / SEQ ID NO:203

Mutant-1: 5'-CAAGCTATACCAAGCATACAATGA............CCGCTGAGCAATAACTAGC-3'
SEQ ID NO:200 / SEQ ID NO:203

Mutant-2: 5'-CAAGCTATACCAAGCATACAATGA............CCGCTGAGCAATAACTAGC-3'
SEQ ID NO:200 / SEQ ID NO:203

Mutant-3: 5'-CAAGCTATACCAAGCATACAATGA............CCGCTGAGCAATAACTAGC-3'
SEQ ID NO:200 / SEQ ID NO:203

Mutant-4: 5'-CAAGCTATACCAAGCATACAATGA............CCGCTGAGCAATAACTAGC-3'
SEQ ID NO:200 / SEQ ID NO:203

Mutant-5: 5'-CAAGCTATACCAAGCATACAATGA............CCGCTGAGCAATAACTAGC-3'
SEQ ID NO:200 / SEQ ID NO:203

Mutant-6: 5'-CAAGCTATACCAAGCATACAATGA............CCGCTGAGCAATAACTAGC-3'
SEQ ID NO:200 / SEQ ID NO:203

Mutant-7: 5'-CAAGCTATACCAAGCATACAATGA............CCGCTGAGCAATAACTAGC-3'
SEQ ID NO:200 / SEQ ID NO:203

METHOD FOR THE RECOMBINATION OF GENETIC ELEMENTS

This application claims the benefit of U.S. Provisional Application No. 60/360,279, filed Feb. 26, 2002.

FIELD OF THE INVENTION

The invention relates to the field of molecular biology. More specifically, the invention relates to a method for the recombination of genetic elements for the generation of new polynucleotides and/or new polypeptides having altered properties.

BACKGROUND OF THE INVENTION

The advent of recombinant genetics has provided a need for the development of proteins with altered or enhanced bio-properties. Methods of engineering proteins are legion and employ both in vivo and in vitro technologies, focusing on translational as well as transcriptional events. Inspired by natural evolution, these techniques generally involve the generation and selection, or screening, of a pool of mutated molecules to identify a protein possessing a specific, desired alteration in functionality. The process typically begins with creation of a library of mutated genes. Gene products which show improvement with respect to the desired property or set of properties are identified by selection or screening. The gene(s) encoding those products can be subjected to further cycles of the process in order to accumulate beneficial mutations. This evolution can involve few or many generations, depending on the desired result and the effects of mutations typically observed in each generation. Such approaches have been used to create novel functional nucleic acids, peptides and other small molecules, antibodies, enzymes, and other proteins. The advantage of these types of "directed evolution" techniques is that little specific knowledge about the product itself is required. Instead, it is only critical to develop methodology to evaluate the function to be optimized.

One of the most widely practiced methods of protein engineering involves a method known as "gene shuffling". Gene shuffling begins with the fragmenting of a DNA template into short, random segments (usually with DNAse I); melting the fragments to produce single strands; and then allowing the strands to re-anneal. Because the strands re-anneal randomly, the dimer often has strands of different lengths and overhangs are generated. These are back-filled using a polymerase and free nucleotides, and the process is repeated until a complete template is generated—albeit with shuffled segments. These methods and variations thereon are described in the following patents: U.S. Pat. No. 5,605,793; U.S. 5,811,238; U.S. 5,830,721; U.S. 5,837,458; U.S. 6,132,970; U.S. 6,291,242; U.S. 6,297,053; U.S. 6,287,861; and U.S. 6,117,679.

An alternate method of shuffling or recombining a gene/DNA fragment to produce an engineered protein makes use of an interrupted polymerase extension process to initially fragment the template. In one method, mutations or adducts are introduced into the template using UV light, chemicals or other mutagens. These mutations serve as points of disruption for a polymerase. After mutagenesis, the strands are denatured, primed with short random primers, and extended. However, the extension takes place only until the point of the mutation or adduct and then stops. In a manner similar to the "gene shuffling" techniques described above, the short fragments are then purified and permitted to randomly reanneal, thereby generating dimers which often comprise strands of different lengths. The overhangs so created are back-filled using a polymerase and free nucleotides, and the process is repeated until a complete template is generated (containing shuffled segments). This method is generally taught in U.S. Pat. No. 5,965,408.

A variation to the methods taught above is provided by Shao et al. (*Nucl. Acids Res.* 26(2): 618-683 (1998)). This random-priming recombination (RPR) method utilizes random sequence primers to generate a large number of short DNA fragments complementary to different sections of the template sequence(s). Then, the short DNA fragments are able to prime one another based on homology and can be recombined and reassembled into full-length genes by repeated thermocycling in the presence of thermostable DNA polymerase.

A further variation of these processes requires design of a set of defined primers which anneal to various portions of the template molecules in series to produce a pool of short double-stranded DNA fragments. This can be accomplished separately with two paired primers per PCR reaction or by use of multiple primers per reaction. The end result yields short double-stranded DNA fragments that anneal randomly to other templates or to different places on the same template in further cycling, permitting shuffling to occur. This method is generally described in U.S. Pat. No. 6,153,410.

An alternate method for recombining genes makes use of the inherent properties of polymerase chain reaction (PCR), and is generally known as recombinogenic PCR. This inherent "shuffling" produced by PCR was first observed by Saiki, R. K. et al. (*Science* 239(4839): 487-91 (1988)), when it was noted that PCR performed with the Klenow fragment of DNA polymerase I resulted in chimeras of different alleles being amplified. It was hypothesized that the shuffled clones arose from "incomplete extension of the annealed primer during one cycle" of elongation, such that "in later cycles, these incomplete products may hybridize to other allelic templates [or otherwise non-identical templates] and be extended, thus producing a mosaic". This phenomenon was thought to occur when the elongating polymerase paused or disengaged from the template before elongation was complete.

The work of Saiki et al. (supra) was followed by that of Meyerhans, A. et al. (*Nucl. Acids Res.* 18(7):1687-91 (1990)). This particular study examined formation of recombinant DNA molecules by PCR co-amplification of 2 distinct HIV1 tat gene sequences. It was determined that the frequency of such recombinants could be decreased 2.7 fold by a 6-fold increase in Taq DNA polymerase elongation time. Judo, M. S. B. et al. (*Nucleic Acids Res.* 26(7): 1819-1825 (1998)) examined the stimulation and suppression of PCR-mediated recombination, or chimera formation. It was determined that PCR cycling programs designed to specifically favor incomplete extension/elongation and subsequent priming of those incompletely extended products via template strand exchange could stimulate recombination >20%. The degree of incomplete elongation was thought to be affected by the processivity of the enzyme and the length of time provided for elongation. In addition, slow cooling between the denaturation step and the annealing step was suggested to favor annealing of incomplete products over more abundant primer. Since incompletely elongated products have a much higher annealing temperature to the template than unextended primer, slow cooling between the denaturation and annealing steps allowed incompletely elongated product to bind template and begin further elongation before the annealing temperature of the primer was reached.

The staggered extension process (StEP) developed in 1998 by Zhao, H. et al. (*Nat. Biotechnol.* 16(3):258-61 (1998); U.S. Pat. No. 6,177,263) was the product of these earlier discoveries concerning recombinogenic PCR. This StEP process consists of priming the template sequence(s), followed by repeated cycles of denaturation and extremely abbreviated annealing/polymerase-catalyzed extension. In each cycle some of the growing fragments could anneal to different templates based on sequence complementarity and extend further. This is repeated until full-length sequences form. Due to template switching, the shuffled polynucleotides contain sequence information from different parental sequences. The method was demonstrated to be efficient for both in vitro mutagenesis and recombination of polynucleotide sequences. The paired primer sequences for StEP are preferentially designed (versus random) to anneal to the 5' and 3' flanking sequences of the templates, although it is noted that the process could also be performed with universal flanking primers.

Finally, the work of Marton et al. (*Nucl. Acids Res.* 19(9): 2423-2426 (1991)) provided one additional insight towards methods of generating recombinant polynucleotides. Specifically, these authors reported that DNA nicking favors PCR recombination, since the use of templates nicked by DNAse increased the in vitro recombination between two templates during a PCR reaction.

The above cited methods are all useful for the generation of recombinant genes for the development of new polypeptides; however, the libraries so produced by these methods suffer from contamination by the unshuffled parental genes, as all of the methods use paired primers that enable primer amplification of the parental template molecules. In the case where the parental genes have poor homology (<80% at the DNA level), the contamination of the unshuffled parental genes results in inefficient and time-consuming screening, which can further result in passing over many useful new recombinants. Additionally, the recombination of the parental genes (e.g., shuffling efficiency, number of crossovers, etc.) largely depends on thermal cycling conditions. When the parental genes have poor homology, it is difficult for the cited methods to quickly optimize the thermal cycling conditions for recombination. This results because one cannot determine if the amplified products are parental genes or shuffled genes. The only solution to this problem is to sequence each library and then adjust the thermal cycling conditions, which is prohibitively time-consuming and expensive.

The problem to be solved, therefore, is to provide a method of gene recombination that eliminates the presence of the parental templates in the libraries to be screened and additionally permits the introduction of new mutations (i.e., deletions, substitutions, insertions). Such a method should additionally allow for facile optimization of recombination conditions.

Applicants have solved the stated problem by providing a method for the recombination of a gene, such that only new recombinogenic products are produced. The method involves the design of unpaired forward and reverse primers having homology to the 5' end of one template and to the 3' end of a different template. Short primer extension periods result in a pool of full-length, recombinogenic extension products having paired 5' and 3' ends that can be further amplified.

SUMMARY OF THE INVENTION

It is an aspect of the invention to provide a method for the recombination of nucleic acid templates of interest comprising: a) providing at least one double-stranded first nucleic acid template and at least one second double-stranded nucleic acid template, wherein the 5' region of the sense strand of the first nucleic acid template is of different sequence than the 5' region of the sense strand of the second nucleic acid template and the 3' region of the sense strand of the first nucleic acid template is of different sequence than the 3' region of the sense strand of the second nucleic acid template; b) providing at least one forward primer that will only anneal to the 3' region of the antisense strand of the first nucleic acid template; c) providing at least one reverse primer that will only anneal to the 3' region of the sense strand of the second nucleic acid template; d) contacting the first and second nucleic acid templates of (a) with the primers of (b) and (c) in a replication composition whereby primer directed extension of the primers takes place; e) terminating extension of the primers of (d) after the addition of no more than about 1000 nucleotides; f) separating the extended forward and reverse primers from the first and second templates; g) re-annealing the extended forward and reverse primers with the first and second templates whereby the extended primers anneal to either the first- or second template; and h) repeating steps (d)-(g) until at least one full-length extension product is generated comprising the recombination of the first and second double-stranded templates.

In an alternate embodiment the method of the invention may be practiced by employing single-stranded templates wherein the first template is the antisense strand of a double-stranded molecule and the second strand is the sense strand of a double-stranded molecule.

In another embodiment the method of the invention may be practiced by employing a first antisense single-stranded template and a forward primer which anneals only to the 3' region of the first template. Alternatively the invention encompasses a method using a second sense single-stranded template where the reverse primer anneals only to the 3' region of the second template.

Optionally the full-length extension products produced by the method of the invention may be purified by means well known in the art.

In a preferred embodiment the invention provides a method for the generation of a recombined polypeptide having altered properties comprising: a) providing at least one double-stranded first nucleic acid template and at least one second-double stranded nucleic acid template, wherein the 5' region of the sense strand of the first nucleic acid template is of different sequence than the 5' region of the sense strand of the second nucleic acid template and the 3' region of the sense strand of the first nucleic acid template is of different sequence than the 3' region of the sense strand of the second nucleic acid template; b) providing at least one forward primer that will only anneal to the 3' region of the antisense strand of the first nucleic acid template; c) providing at least one reverse primer that will only anneal to the 3' region of the sense strand of the second nucleic acid template; d) contacting the first and second nucleic acid templates of (a) with the primers of (b) and (c) in a replication composition whereby primer directed extension of the primers takes place; e) terminating extension of the primers of (d) after the addition of no more than about 1000 nucleotides; f) separating the extended forward and reverse primers from the first and second templates; g) re-annealing the extended forward and reverse primers with the first and second templates whereby the extended primers anneal to either the first or second template; h) repeating steps (d)-(g) until at least one full-length extension product is generated comprising the recombination of the first and second templates; i) expressing the full-length extension product of (h) to generate a recombined polypeptide; and j) screening the recombined polypeptide of (i) for altered properties as compared with the polypeptide expressed from either the first or second double-stranded nucleic acid template.

Alternatively the method for the generation of a recombined polypeptide may employ single-stranded templates wherein the first template is the antisense strand of a double-stranded nucleic acid molecule and the second template is the sense strand of a double-stranded molecule.

The invention additionally provides new polypeptides as set forth in SEQ ID NO:12, 14 16, 18, 20, 22, and 24.

BRIEF DESCRIPTION OF THE DRAWINGS AND SEQUENCE DESCRIPTIONS

FIG. 3 shows the DNA sequence analyses of the 5' and 3' ends of seven recombinant DNA products made from RM120-1 and RM492-1 using the recombinogenic extension method using unpaired primers.

Figure 4:
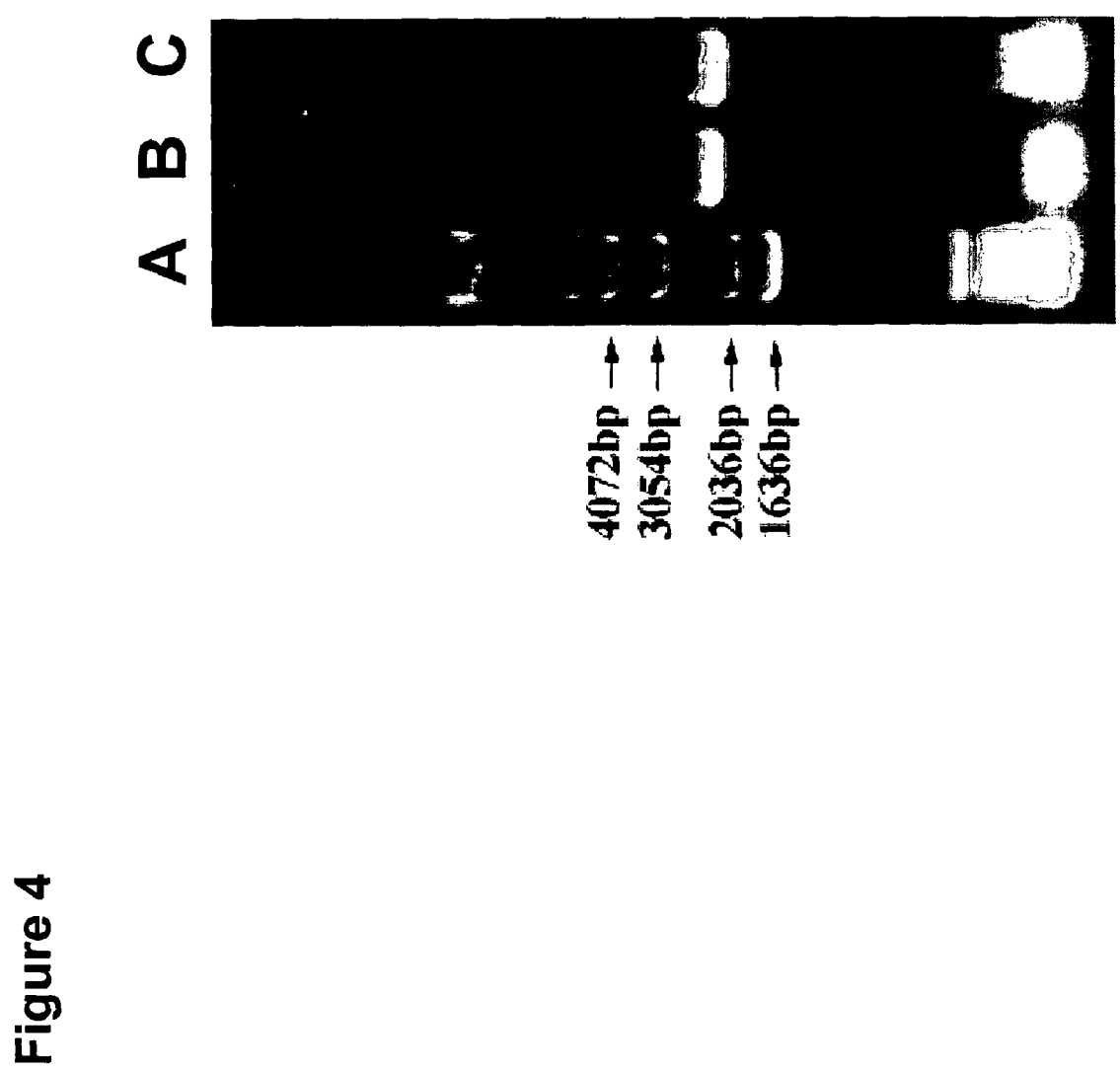

FIG. 4 is an agarose gel showing the results of two unpaired primer reactions. Lane A is a standard molecular weight marker; Lane B shows recombination of two parent genes (Example 4); and Lane C shows recombination of three parent genes (Example 5).

Figure 5:
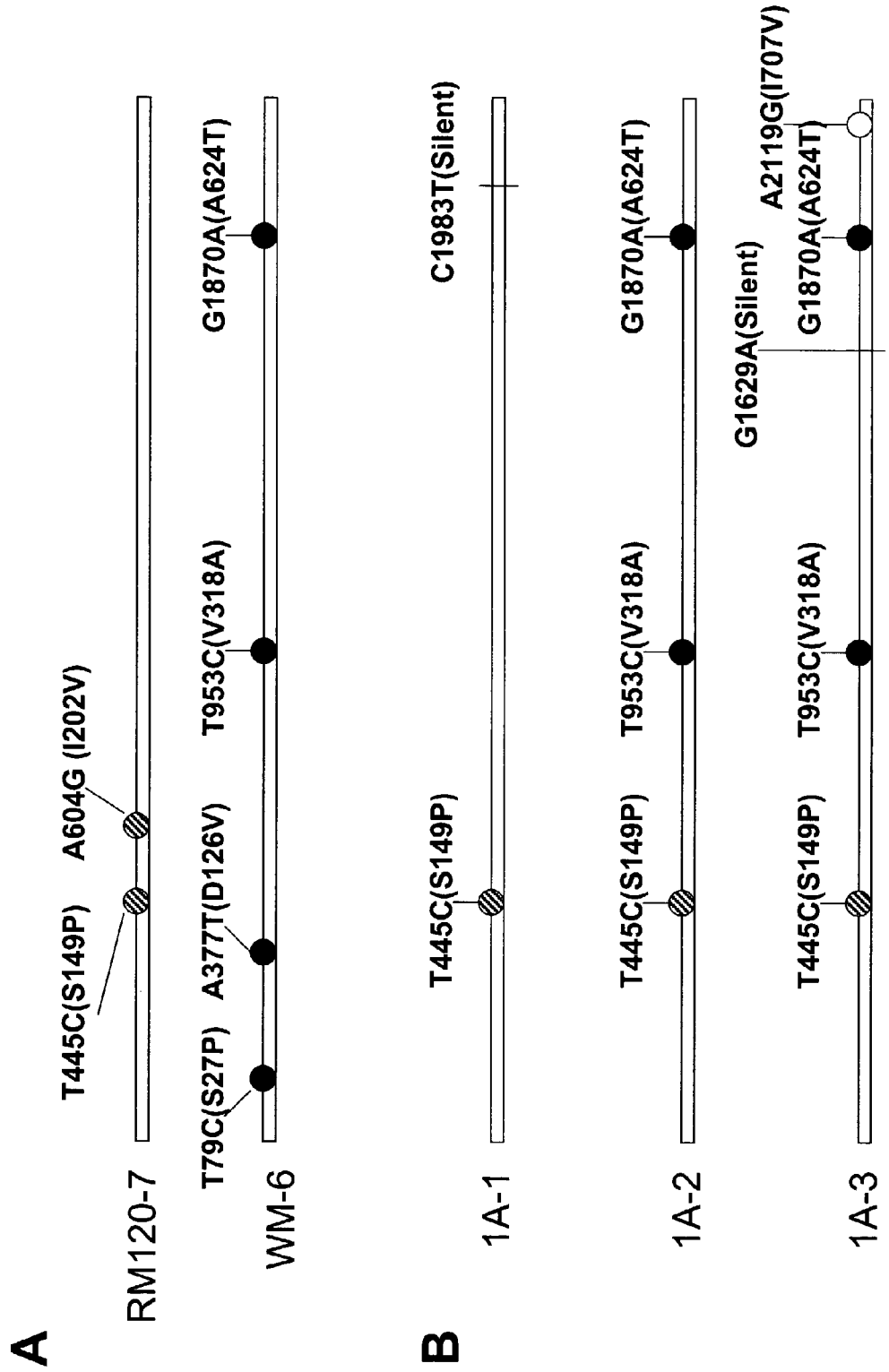

FIG. 5 shows the sequence comparison between the 2 parent genes and the recombinant mutant genes from the two-gene recombination experiment.

Figure 6:
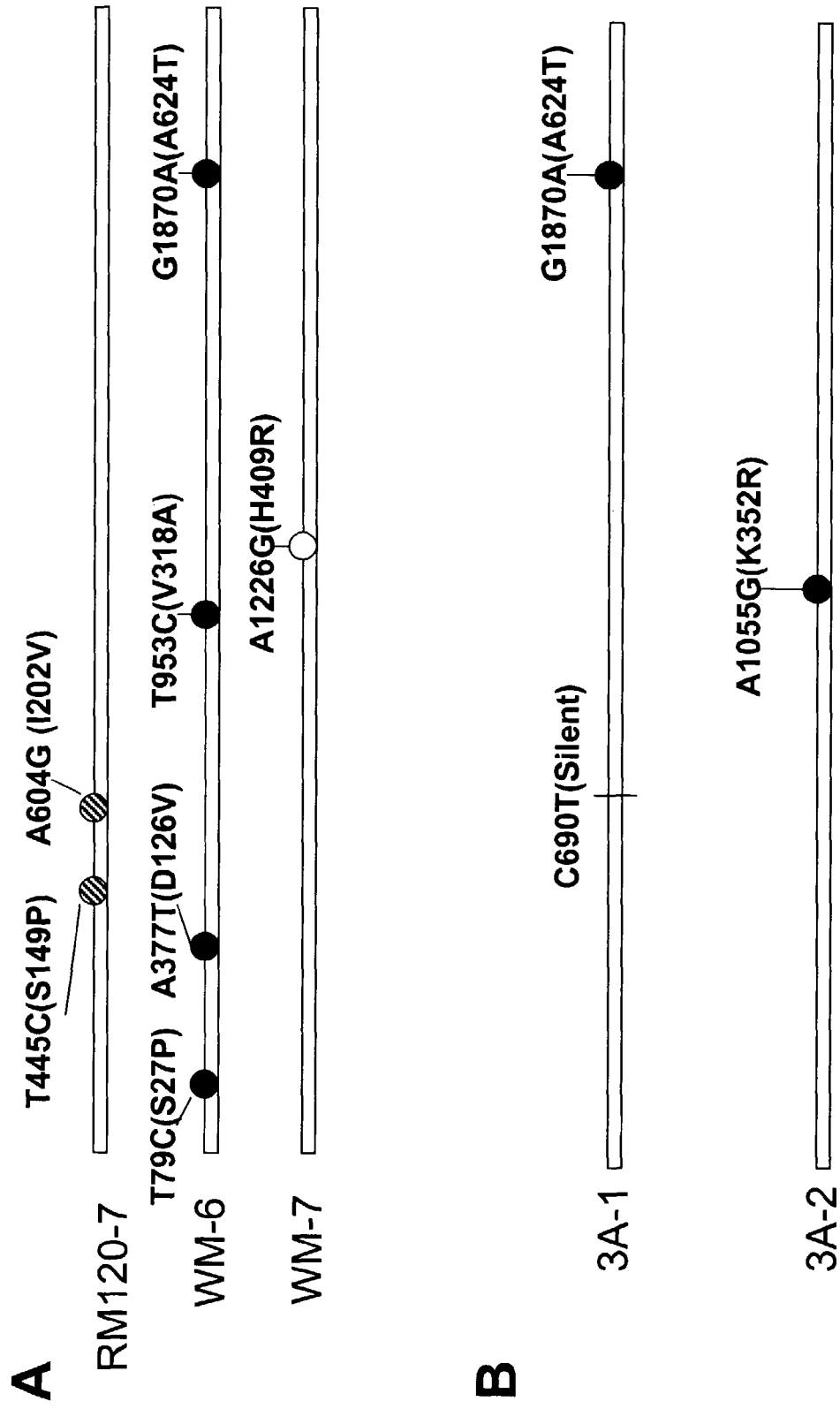

FIG. 6 shows the sequence comparison between the 3 parent genes and the recombinant mutant genes from the three-gene recombination experiment.

Figure 7:
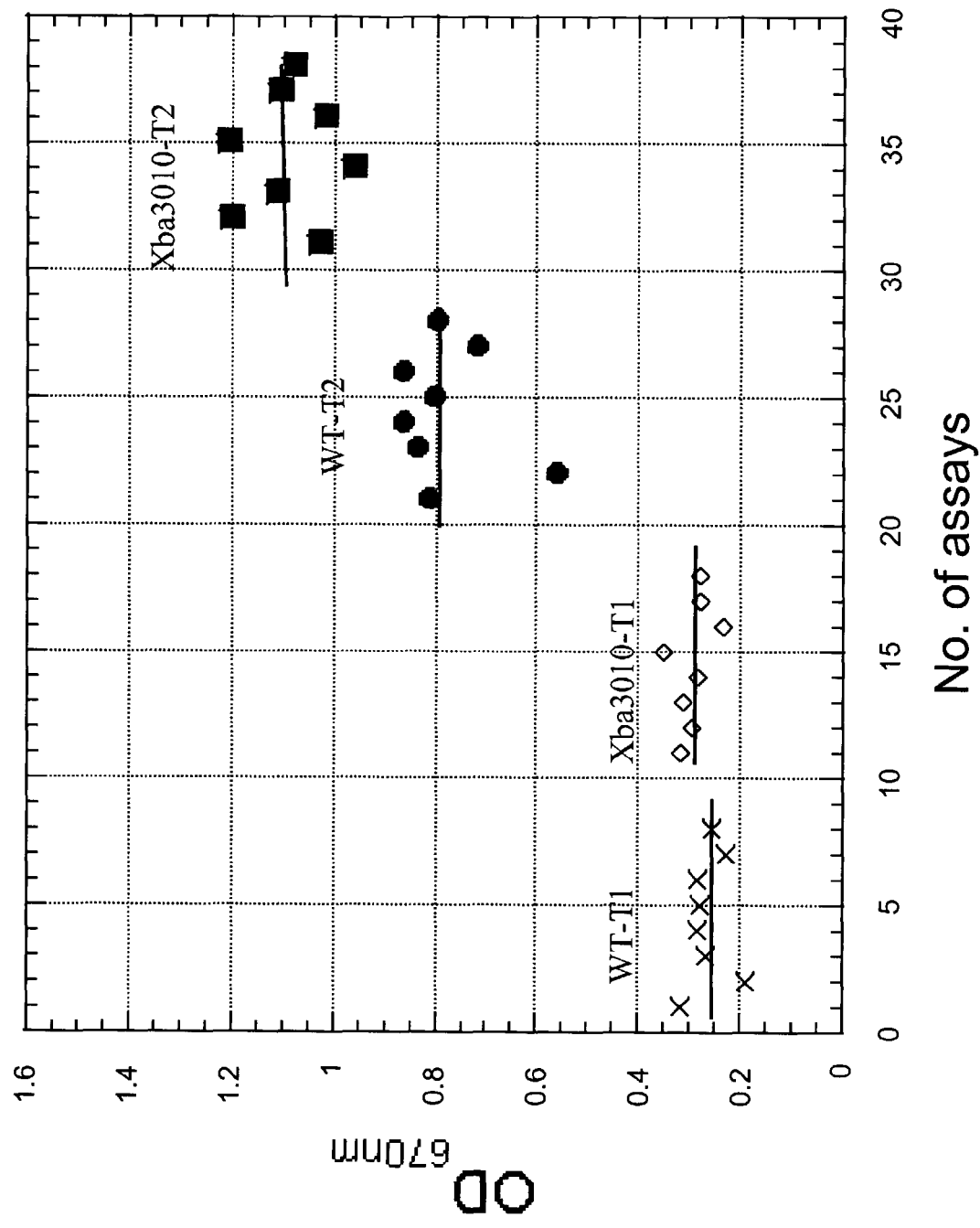

FIG. 7 graphically illustrates results of a typical GDH follow-up assay, as described in Example 9.

The invention can be more fully understood from the following detailed description and the accompanying sequence descriptions which form a part of this application.

The following sequences are in conformity with 37 C.F.R. 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

PAL and TAL enzymes derived from *Rhodosporidium glutinis* are assigned the following SEQ ID NOs, according to their respective nucleic acid sequences and amino acid sequences (Table 1):

TABLE 1

Full-length PAL/TAL Genes and their Respective SEQ ID NOs

| Gene | Description | Nucleic Acid SEQ ID NO: | Amino Acid SEQ ID NO: | Reference |
|---|---|---|---|---|
| PAL | Wildtype | 1 | 2 | U.S. Pat. No. 6,521,748 |
| EP18Km-6 | Mutant PAL having enhanced TAL activity | 3 | 4 | U.S. Pat. No. 6,521,748 |
| RM120-1 | Mutant TAL enzyme | 5 | 6 | U.S. Pat. No. 6,521,748 |
| RM120-7 | Mutant TAL enzyme | 7 | 8 | U.S. Pat. No. 6,521,748 |
| RM492-1 | Mutant TAL enzyme | 9 | 10 | U.S. Pat. No. 6,521,748 |
| WM-6 | Mutant TAL enzyme | 11 | 12 | Described herein |
| WM-7 | Mutant TAL enzyme | 13 | 14 | Described herein |
| 1A-1 | Mutant TAL enzyme | 15 | 16 | Described herein |
| 1A-2 | Mutant TAL enzyme | 17 | 18 | Described herein |
| 1A-3 | Mutant TAL enzyme | 19 | 20 | Described herein |
| 3A-1 | Mutant TAL enzyme | 21 | 22 | Described herein |
| 3A-2 | Mutant TAL enzyme | 23 | 24 | Described herein |

SEQ ID NOs:25-28 are the primer sequences known as 2000YF1, 18-3', 18-5', and 2000YR19T7, respectively.

SEQ ID NOs:29 and 30 are the primers PADH316F1 and T7T used for the generation of recombinant DNA products.

SEQ ID NO:31 is the primer sequence known as 18-3'AC. SEQ ID NO:32 is a 12.1 kB EcoRI-SalI fragment containing the wild-type GDH isolated from *Klebsiella pneumoniae* ATCC 25955 (Emptage et al., WO 01/012833 A2). The wild-type GDH is encoded by the α-subunit (bp 7044-8711), the β-subunit (bp 8724-9308), and the γ-subunit (bp 9311-9736). The amino acid sequences of the α, β, and γ-subunits of GDH are provided as SEQ ID NO:33, SEQ ID NO:34, and SEQ ID NO:35, respectively.

SEQ ID NOs:36 and 37 encode primers DHA-F1 and DHA-R1, respectively, used for cloning GDH from plasmid pGH20.

SEQ ID NO:38 encodes reverse primer DHA-R2, utilized for cloning the entire α- and a portion of the β-subunit of GDH.

SEQ ID NOs:39-44 encode primers pGD20RM-F1, pGD20RM-R1, TB4BF, TB4BR, pGD20RM-F2, and pGD20RM-R2, respectively, used for regional random mutagensis of the α-subunit of GDH.

SEQ ID NOs:45-47 encode degenerate primers pGD20RM-F3, TB4B-R1, and pGD20RM-R4, respectively, used for preparation of regional random mutant libraries.

SEQ ID NO:48 encodes the linker between the α- and β-subunits of fusion protein Sma3002. SEQ ID NO:49 encodes the linker between the α- and β-subunits of fusion protein Xba3009.

SEQ ID NOs:50-53 encode primers 1-E1-F1, 1-E1-R1, 22-G7-F1, and 22-G7-R1, respectively, used for creating the pure fusion mutants 1-E1 and 22-G7.

SEQ ID NOs:54-59 encode primers 8-C9-F1, 8-C9-R1, 9-D7-F1, 9-7-R1, 10-G6-F1, and 10-G6-R1, respectively, used for synthesis of Sma3002-derived mutants.

SEQ ID NOs:60-62 are the primer sequences known as T53-SM-for, L509-SM-for, and V224-SM-for, respectively, used for making saturation mutagenesis libraries.

SEQ ID NOs:63-66 are the 5' and 3' flanking segments known as GDHM-F1, GDHM-R1, GDHM-F2, and GDHM-R2, respectively, used to amplify parent GDH enzymes for use in the recombinogenic extension method.

SEQ ID NO:67 is a 2693 bp fragment derived from SEQ ID NO:32, containing the α, β, and γ-subunits of GDH and one silent mutation (TCA (α-Ser4) to TCT (Ser)). The amino acid sequences of the α, β, and γ-subunits of this GDH are provided as SEQ ID NO:68, SEQ ID NO:69, and SEQ ID NO:70, respectively.

SEQ ID NO:67 is a 2693 bp fragment derived from SEQ ID NO:32, containing the α, β, and γ-subunits of GDH and one silent mutation (TCA (α-Ser4) tp TCT (Ser)). The amino acid sequences of the α, β, and γ-subunits of this GDH are provided as SEQ ID NO:68, SEQ ID NO:69, and SEQ ID NO:70, respectively.

Mutant enzymes derived from the wild-type GDH encoded by SEQ ID NO:67 are assigned the following SEQ ID NOs, according to their respective nucleic acid sequences and amino acid sequences (Table 2):

TABLE 2

Full-length Mutant GDHs and their Respective SEQ ID NOs

| Gene | Description | Nucleic Acid SEQ ID NO: | Amino Acid SEQ ID NO*: |
|---|---|---|---|
| Xba3007 | Mutant GDH enzyme | 71 | 72, 73, 74 |
| Xba3029 | Mutant GDH enzyme | 75 | 76, 77, 78 |
| Xba3025 | Mutant GDH enzyme | 79 | 80, 81, 82 |
| Xba3015 | Mutant GDH enzyme | 83 | 84, 85, 86 |
| Xba3008 | Mutant GDH enzyme | 87 | 88, 89, 90 |
| Xba3016 | Mutant GDH enzyme | 91 | 92, 93, 94 |
| Xba3020 | Mutant GDH enzyme | 95 | 96, 97, 98 |
| Xba3010 | Mutant GDH enzyme | 99 | 100, 101, 102 |
| Xba3023 | Mutant GDH enzyme | 103 | 104, 105, 106 |
| Xba3009 | Mutant GDH enzyme | 107 | 108, 109 |
| Sma3002 | Mutant GDH enzyme | 110 | 111, 112 |
| Sma3003 | Mutant GDH enzyme | 113 | 114, 115, 116 |
| Sma3009 | Mutant GDH enzyme | 117 | 118, 119, 120 |
| Sma3010 | Mutant GDH enzyme | 121 | 122, 123, 124 |
| Sma3008 | Mutant GDH enzyme | 125 | 126, 127, 128 |
| PpuMI002 | Mutant GDH enzyme | 129 | 130, 131, 132 |
| RsrII001 | Mutant GDH enzyme | 133 | 134, 135, 136 |
| 4BR1001 | Mutant GDH enzyme | 137 | 138, 139, 140 |
| KG005 | Mutant GDH enzyme | 141 | 142, 143, 144 |
| 1-E1 | Mutant GDH enzyme | 145 | 146, 147 |
| 22-G7 | Mutant GDH enzyme | 148 | 149, 150 |
| 8-C9 | Mutant GDH enzyme | 151 | 152, 153 |
| 9-D7 | Mutant GDH enzyme | 154 | 155, 156 |
| 10-G6 | Mutant GDH enzyme | 157 | 158, 159 |
| GDH-SM1-G11 | Mutant GDH enzyme | 160 | 161, 162 |
| GDH-SM2-B11 | Mutant GDH enzyme | 163 | 164, 165 |
| GDH-SM3-D2 | Mutant GDH enzyme | 166 | 167, 168 |
| GDH-SM4-H2 | Mutant GDH enzyme | 169 | 170, 171 |
| SHGDH37 | Mutant GDH enzyme | 172 | 173, 174 |
| SHGDH51 | Mutant GDH enzyme | 175 | 176, 177 |
| SHGDH12 | Mutant GDH enzyme | 178 | 179, 180 |
| SHGDH22 | Mutant GDH enzyme | 181 | 182, 183 |
| SHGDH38 | Mutant GDH enzyme | 184 | 185, 186 |
| SHGDH24 | Mutant GDH enzyme | 187 | 188, 189 |
| SHGDH43 | Mutant GDH enzyme | 190 | 191, 192 |
| SHGDH25 | Mutant GDH enzyme | 193 | 194, 195 |
| SHGDH29 | Mutant GDH enzyme | 196 | 197, 198 |

*The amino acid SEQ ID NO's correspond to the α, β, and γ-subunits of GDH, respectively. Alternatively, the amino acid SEQ ID NO's correspond to an α-β fusion and the γ-subunit of GDH.

SEQ ID NO:199 is primer GD-C, used for making the 4BR-1 library.

SEQ ID NO:200 is the 5' region of the mutant TAL enzyme, RM120-1, as shown in FIG. 3.

SEQ ID NO:201 is the 3' region of the mutant TAL enzyme, RM120-1, as shown in FIG. 3.

SEQ ID NO:202 is the 5' region of the mutant TAL enzyme, RM492-1, as shown in FIG. 3.

SEQ ID NO:203 is the 3' region of the mutant TAL enzyme, RM492-1, as shown in FIG. 3.

DETAILED DESCRIPTION OF THE INVENTION

The present invention describes a method for the recombination of polynucleotides. The method makes use of unpaired forward and reverse primers, the forward primer annealing to the 5' end of one template and the reverse primer annealing to the 3' end of a different template. Primer directed amplification of the templates using truncated primer extension results in the generation of a recombinant product having paired 5' and 3' ends. Amplification of these full-length recombinant extension products results in a library devoid of any parental templates. Optionally these full-length recombinant extension products can be recombined further. The method of the invention is useful for genetic recombination of molecules sharing greater than 50% homology with one another, in order to create vast pools of recombinant molecules. These recombinant molecules may then be selected, or screened, for identification of altered properties such as stability (i.e., against proteases, solvents, detergents, temperature, inhibitors), folding or structural properties, or activity or specificity, in the case of enzymes.

Abbreviations and Definitions

In this disclosure, a number of terms and abbreviations are used. The following definitions are provided.

"Open reading frame" is abbreviated ORF.

"Polymerase chain reaction" is abbreviated PCR.

"Phenylalanine ammonia-lyase" is abbreviated PAL.

"4-hydroxycinnamic acid" is abbreviated PHCA.

"Tyrosine ammonia-lyase" is abbreviated TAL.

"3-Hydroxypropionaldehyde" is abbreviated 3-HP.

The term "PAL activity" refers to the ability of a protein to catalyze the conversion of phenylalanine to cinnamic acid.

The term "TAL activity" refers to the ability of a protein to catalyze the direct conversion of tyrosine to PHCA.

The term "PAL/TAL activity" or "PAL/TAL enzyme" refers to a protein which contains both PAL and TAL activity. Such a protein has at least some specificity for both tyrosine and phenylalanine as an enzymatic substrate.

The term "mutant PAL/TAL" refers to a protein which has been derived from a wild-type PAL enzyme. The mutant PAL/TAL has an altered TAL/PAL ratio compared to the wild-type enzyme. The term "TAL/PAL ratio" refers to a calculation that permits rapid comparison of TAL and PAL activity, and that indicates the substrate specificity of the enzyme. The ratio is determined following separate measurements of the TAL and PAL activities in whole cells. This ratio facilitates rapid assessment of genes possessing altered PAL or TAL activity (with respect to wild-type activity) and permits changes in the substrate specificity to be monitored.

The term "GDH" refers specifically to the $B_{12}$-dependent glycerol dehydratase isolated from *Klebsiella pneumoniae* ATCC 25955 and encoded by bp 7044-8711, bp 8724-9308, and bp 9311-9736 of SEQ ID NO:32 or a derivative therefrom, encoded by SEQ ID NO:67. The term "GDH" is used to refer to the assembled complex of α, β, and γ-subunits and may refer to apoenzyme or holoenzyme. Reference to an individual subunit of GDH will specify the subunit, for example "α-subunit of GDH" or "GDH α-subunit". Similarly, reference may be made to the amino acid sequence of GDH, referring collectively to the α- and the β- and the γ-subunits; or, to an individual subunit of GDH. The amino acid sequences of the α, β, and γ-subunits of GDH are provided as SEQ ID NO:33, SEQ ID NO:34, and SEQ ID NO:35 and SEQ ID NO:68, SEQ ID NO:69, and SEQ ID NO:70, respectively. For the purposes of this invention disclosure, wild-type GDH (encoded by SEQ ID NO:67) is used as a reference for DNA and amino acid sequence as compared to engineered (mutant) derivatives. GDH is also used as a reference for wild-type reaction kinetics against which the reaction kinetics of the engineered derivatives created by use of the invention are measured.

The term "mutant GDH" refers to a bacterial clone, plasmid, library or vector containing a GDH enzyme or a GDH sequence that has been generated by a process of mutation. Alternatively, the term mutant refers directly to a GDH enzyme, GDH amino acid sequence, or GDH DNA sequence that has been generated by a process of mutation. Thus, the mutant GDH is different than the (wild-type) GDH.

The term "improved reaction kinetics" refers to a reduced rate of dehydratase inactivation in the presence of glycerol and/or 1,3-propanediol, with respect to the wildtype enzyme. Thus, improved reaction kinetics are related to an increased total enzyme turnover number in the presence of glycerol and 1,3-propanediol. This can be achieved by either increasing the $k_{cat}$ and/or decreasing the rate of enzyme inactivation.

The term "catalytic efficiency" is defined as the $k_{cat}/K_M$ of an enzyme. "Catalytic efficiency" is used to quantitate the specificity of an enzyme for a substrate.

The terms "$k_{cat}$" and "$K_M$" are known to those skilled in the art and are described in Enzyme Structure and Mechanism, $2^{nd}$ ed. (Ferst; W. H. Freeman: NY, 1985; pp 98-120). The term "$k_{cat}$", often called the "turnover number", is defined as the maximum number of substrate molecules converted to products per active site per unit time, or the number of times the enzyme turns over per unit time. $k_{cat}=V_{max}/[E]$, where [E] is the enzyme concentration (Ferst, supra). The terms "total turnover" and "total turnover number" are used herein to refer to the amount of product formed by the reaction of a $B_{12}$-dependent dehydratase holoenzyme with glycerol (and, optionally, in the presence of 1,3-propanediol) in the time period between initiation of the reaction ($T_0$) and that time where complete inactivation of the holoenzyme has occurred.

The term "T1" refers to the amount of product made by a GDH enzyme reaction at 30 seconds after the reaction's initation in the presence of 10 mM glycerol and 50 mM 1,3-propanediol. T1 is proportional to $k_{cat}$.

The term "T2" refers to the amount of product made by a GDH enzyme reaction measured at 40 minutes after the reaction's initation in the presence of 10 mM glycerol and 50 mM 1,3-propanediol. T2 is proportional to $k_{cat}/k_{inact\ obsd}$, reflecting the enzyme's total turnover number.

The term "T2/T1 ratio" refers to the ratio of T2 to T1. The T2/T1 ratio is proportional to $1/k_{inact\ obsd}$.

The term "T(600)" refers to the amount of product made by a GDH enzyme reaction measured at 70 minutes after the reaction's initation in the presence of 10 mM glycerol and 600 mM 1,3-propanediol. T(600) is proportional to $k_{cat}/k_{inact\ obsd}$.

The terms "host cell" and "host organism" refer to a microorganism capable of receiving foreign or heterologous genes and of expressing those genes to produce an active gene product.

As used herein, an "isolated nucleic acid fragment" is a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

The terms "protein" or "peptide" or "polypeptide" will be used interchangeably and will refer to a sequence of contiguous amino acids having a defined function. "Wild-type proteins" will refer to proteins isolated from nature in an unaltered form. A "mutant protein" will refer to a wildtype protein having alterations in the amino acid sequence.

The term "recombination" will refer to a process whereby genetic combinations are formed which were not present in parent template molecules, by the processes of crossing-over or independent assortment. Thus, recombination includes all combinations of genetic sequences that can be obtained from the parent template molecules (whereby each nucleotide position of the newly generated "recombinogenic product(s)" can be derived from any of the parent templates at that particular nucleotide position); and additionally, recombination includes the introduction of new mutations (i.e., deletions, substitutions, insertions).

The term "recombined polypeptide" means a polypeptide encoded by the recombined genes, DNA, or RNA of the invention. Recombined polypeptides will often have altered or enhanced properties.

The term "altered properties" as applied to a polypeptide or protein will refer to a characteristic, associated with a protein encoded by a nucleotide sequence that can be measured by an assay method, where that characteristic is either enhanced or diminished compared to that associated with the native sequence. Examples of preferred properties of an enzyme that may be altered include the enzyme's activity, substrate specificity, stability against inhibitors, thermal stability, protease stability, solvent stability, detergent stability, and folding properties. "Enhanced biological property" refers to an altered property that is greater than that associated with the native sequence. "Diminished biological property" is an altered property that is less than that associated with the native sequence.

The term "molecular marker" will refer to a specific mutation in a nucleic acid molecule which can be used to quickly access recombination of a nucleic acid molecule. This determination is accomplished by sequencing of the nucleic acid molecule and evaluating the presence or absence of the "molecular marker" with respect to the surrounding nucleotide sequence.

The term "template(s)" or "parent template(s)" refers to a nucleic acid molecule that is copied by a DNA or RNA polymerase according to the rules of Watson-Crick base pairing to produce a new strand of DNA or RNA. The sequence information in the template (or "model") is preserved, since the first copy produced from that template molecule has a complementary sequence. Template molecules may be single- or double-stranded and derived from any source. Double-stranded templates will typically encode polypeptides and will be comprised of a sense strand and an antisense strand. Single-stranded templates will typically be generated from a double-stranded molecule where one template is the sense strand of one molecule and the other template is the antisense strand of another molecule.

"Allelic variants" are defined herein as a type of template, whereby the templates are members of a pair of homologous genes.

"Replication" is the process in which a complementary copy of a nucleic acid strand of the "template" nucleic acid is synthesized by a polymerase enzyme. In "primer-directed" replication, this process requires a hydroxyl group (OH) at the 3' position of a (deoxy)ribose moiety of the terminal nucleotide of a "duplexed" "oligonucleotide" for replication initiation.

The "3' region" of a nucleic acid is that end at which the terminal nucleoside is attached by its 5' carbon of the ribose or deoxyribose to the phosphoric group of the preceding nucleotide. The "5' region" of a nucleic acid is that end at which the terminal nucleoside is attached by its 3' carbon of the ribose or deoxyribose to the phosphoric group of the preceding nucleotide. These regions together flank a region of nucleotides wherein it is desirable for recombination to occur; and, these regions may be within a template molecule(s) or within a flanking DNA sequence that is attached to the template molecule(s). Unpaired primers will anneal to a portion of these 5' and 3' regions.

A "flanking sequence" or "flanking DNA fragment" will refer to a short segment of DNA that is attached to either the 5' or 3' region of a template molecule, in order to provide a unique nucleotide sequence (with respect to the template molecule) to which an unpaired primer may anneal. This DNA flanking sequence may optionally contain a unique restriction enzyme site.

A "full-length extension product" is a nucleotide sequence produced by primer-directed replication that has a length very similar (within about 100 bases) to that contained between the 5' and 3' region of the parent templates.

"Amplification" is the process in which replication is repeated in cyclic manner, such that the number of copies of the "template" nucleic acid is increased in either a linear or logarithmic fashion.

The term "primer" refers to an oligonucleotide (synthetic or occurring naturally), which is capable of acting as a point of initiation of nucleic acid synthesis or replication along a complementary strand of a template molecule, when placed under conditions in which synthesis of a complementary stand is catalyzed by a polymerase. The primer must have the ability to anneal to the complementary strand, based on sequence complementarity between the primer itself and the complementary strand of nucleic acid; however, some mismatch in bases is tolerated. Requirements for primer size, base sequence, complementarity and target interaction are discussed in greater detail below. The term "primer", as such, is used generally herein by Applicants to encompass any sequence-binding oligonucleotide which functions to initiate the nucleic acid replication process (i.e., by priming synthesis).

The term "forward primer" will refer to a primer that has identical sequence to a 5' region on a sense strand of a template molecule, and anneals to a 3' region on an antisense strand of that same template molecule. The template molecule can be either a double-stranded or a single-stranded molecule. Where the template is single-stranded, it is in antisense orientation to allow for priming at the 3' end. Additionally, the forward primer must be suitable for initiation of primer directed extension.

The term "reverse primer" will refer to a primer that has identical sequence to a 5' region on an antisense strand of a template molecule, and anneals to a 3' region on a sense strand of that same template molecule. The template molecule can be either a double-stranded or a single-stranded molecule. Where the template is single-stranded, it will be in the sense orientation to allow for priming at the 3' end. Additionally, the reverse primer must be suitable for initiation of primer directed extension.

The term "paired primers" will refer to a pair of primers, consisting of a forward and reverse primer, which are designed to anneal to a single template molecule and permit synthesis of an exact copy of that template by a primer directed nucleic acid amplification process. In the case of a double-stranded template molecule, the forward and reverse primers enable the synthesis of an exact copy of the double-stranded template since the forward primer produces an exact copy of the antisense strand (that is, a complementary copy of the sense strand which it is using as a template) and the reverse primer produces an exact copy of the sense strand (that is, a complementary copy of the antisense strand which it is using as a template). In contrast, when the template molecule is single-stranded, an exact copy of that template is produced using a primer directed nucleic acid amplification process.

The term "unpaired primers" will refer to a pair of primers, consisting of a forward and reverse primer, which are not designed to anneal to a single template molecule and permit synthesis of an exact copy of that template by a primer directed nucleic acid amplification process. Instead, the forward primer will anneal to a first template molecule, but will not be able to anneal to a second template molecule. The reverse primer will anneal to a second template molecule that is different in sequence from the first template molecule, and yet will not be able to anneal to the first template molecule. This unique design of unpaired primers ensures that a single- or double-stranded template molecule can not be amplified by a primer directed nucleic acid amplification process, unless recombination occurs during replication via template switching.

The terms "recombinogenic extension method using unpaired primers" and "the unpaired primers method" will be used interchangeably to refer to the method disclosed in the present invention, wherein recombinogenic products are created from template molecules using a method based on unpaired primers.

The term "primer directed extension" refers to any method known in the art wherein primers are used to sponsor replication of nucleic acid sequences in the linear or logarithmic amplification of nucleic acid molecules. Applicants contemplate that primer-directed extension may be accomplished by any of several schemes known in this art including, but not limited to: polymerase chain reaction (PCR), ligase chain reaction (LCR), and strand-displacement amplification (SDA).

The term "replication composition" refers to a composition comprising the ingredients necessary for performing nucleic acid replication including nucleotide triphosphates, divalent ions, reaction buffer, and in the case of primer-directed replication at least one primer with appropriate sequences, DNA or RNA polymerase and other necessary proteins.

The term "nicking" refers to a process whereby a phosphodiester bond in the backbone of strand "A" of a double-stranded molecule is broken, while the corresponding phospho-diester bond in the backbone of strand "B" remains intact. Thus, the molecule is not cleaved into two separate fragment molecules. An example of a typical enzyme suitable for nicking DNA molecules is DNAse I.

A nucleic acid molecule is "hybridizable" to another nucleic acid molecule, such as a cDNA, genomic DNA, or RNA, when a single-stranded form of the nucleic acid molecule can anneal to the other nucleic acid molecule under the appropriate conditions of temperature and solution ionic strength. Hybridization is well known and exemplified in Sambrook, J., Fritsch, E. F. and Maniatis, T. *Molecular Cloning: A Laboratory Manual*, $2^{nd}$ ed., Cold Spring Harbor Laboratory: Cold Spring Harbor, N.Y., (1989) (entirely incorporated herein by reference).

The term "anneal" refers to the pairing of complementary DNA or RNA sequences, via hydrogen bonding, to form a double-stranded polynucleotide. For the purposes of the disclosure herein, "anneal" will refer to the process by which a primer binds to a template molecule; however, the terminology does not require 100% complementarity between the primer and the template, since some mismatch is tolerated.

The term "complementary" is used to describe the relationship between nucleotide bases that are capable of hybridizing to one another. For example, with respect to DNA, adenosine is complementary to thymine and cytosine is complementary to guanine. Accordingly, the instant invention includes isolated nucleic acid fragments that are complementary to the complete sequences as reported in the accompanying Sequence Listing, as well as those substantially similar nucleic acid sequences.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., ed.) Oxford University: NY (1988); 2.) *Biocomputing: Informatics and Genome Projects* (Smith, D. W., ed.) Academic: NY (1993); 3.) *Computer Analysis of Sequence Data, Part I* (Griffin, A. M., and Griffin, H. G., eds.) Humana: NJ (1994); 4.) *Sequence Analysis in Molecular Biology* (von Heinje, G., ed.) Academic (1987); and 5.) *Sequence Analysis Primer* (Gribskov, M. and Devereux, J., eds.) Stockton: NY (1991). Preferred methods to determine identity are designed to give the longest match between the sequences tested. Methods to determine identity and similarity are codified in publicly available computer programs. Preferred computer program methods to determine identity and similarity between two sequences include, but are not limited to: the GCG Pileup program found in the GCG program package, as used in the instant invention, using the Needleman and Wunsch algorithm with their standard default values of gap creation penalty=12 and gap extension penalty=4 (Devereux et al., *Nucleic Acids Res.* 12:387-395 (1984)); and BLASTP, BLASTN, and FASTA (Pearson et al., *Proc. Natl. Acad. Sci. U.S.A.* 85:2444-2448 (1988). The BLAST X program is publicly available from NCBI and other sources (*BLAST Manual*, Altschul et al., Natl. Cent. Biotechnol. Inf., Natl. Library Med. (NCBI NLM) NIH, Bethesda, Md.; Altschul et al., *J. Mol. Biol.* 215:403-410 (1990)). Another preferred method to determine percent identity is by the method of the DNASTAR protein alignment protocol using the Jotun-Hein algorithm (Hein et al., *Methods Enzymol.* 183:626-645 (1990)). Default parameters for the Jotun-Hein method for alignments are: 1.) for multiple alignments, gap penalty=11, gap length penalty=3; and 2.) for pairwise alignments ktuple=6.

For example, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These mutations of the reference sequence may occur at the 5' or 3' terminal positions of the reference nucleotide sequence or anywhere between those terminal positions, interspersed either individually among nucleotides in the reference sequence or in one or more contiguous groups within the reference sequence.

"Codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "amino acid" will refer to the basic chemical structural unit of a protein or polypeptide. The following abbreviations will be used herein to identify specific amino acids:

| Amino Acid | Three-Letter Abbreviation | One-Letter Abbreviation |
|---|---|---|
| Alanine | Ala | A |
| Arginine | Arg | R |
| Asparagine | Asn | N |
| Aspartic acid | Asp | D |
| Asparagine or aspartic acid | Asx | B |
| Cysteine | Cys | C |
| Glutamine | Gln | Q |
| Glutamic acid | Glu | E |
| Glutamine or glutamic acid | Glx | Z |
| Glycine | Gly | G |
| Histidine | His | H |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

It is well known in the art that many amino acids may be substituted for another amino acid in a given protein without altering the chemical or functional nature of that protein. For example, it is well known in the art that alterations in a gene which result in the production of a chemically equivalent amino acid at a given site, but do not effect the functional properties of the encoded protein, are common. For the purposes of the present invention, substitutions are defined as exchanges within one of the following five groups:

1. Small aliphatic, nonpolar or slightly polar residues: Ala, Ser, Thr (Pro, Gly);
2. Polar, negatively charged residues and their amides: Asp, Asn, Glu, Gln;
3. Polar, positively charged residues: His, Arg, Lys;
4. Large aliphatic, nonpolar residues: Met, Leu, Ile, Val (Cys); and
5. Large aromatic residues: Phe, Tyr, Trp.

Thus, alanine, a hydrophobic amino acid, may be substituted by another less hydrophobic residue (such as glycine) or a more hydrophobic residue (such as valine, leucine, or isoleucine). Similarly, changes which result in substitution of one negatively charged residue for another (such as aspartic acid for glutamic acid) or one positively charged residue for another (such as lysine for arginine) can also be expected to produce a functionally equivalent product. Additionally, in many cases, alterations of the N-terminal and C-terminal portions of the protein molecule would also not be expected to alter the activity of the protein.

"Gene" refers to a nucleic acid fragment that expresses a specific protein, including regulatory sequences preceding (5' non-coding sequences) and following (3' non-coding sequences) the coding sequence. "Native gene" or "wild-type gene" refers to a gene as found in nature with its own regulatory sequences. "Chimeric gene" refers to any gene that is not a native gene, comprising regulatory and coding sequences that are not found together in nature or comprising a "non-native" gene that was created by recombination of two or more related genes. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

"Synthetic genes" can be assembled from oligonucleotide building blocks that are chemically synthesized using procedures known to those skilled in the art. These building blocks are ligated and annealed to form gene segments which are then enzymatically assembled to construct the entire gene. "Chemically synthesized", as related to a sequence of DNA, means that the component nucleotides were assembled in vitro. Manual chemical synthesis of DNA may be accomplished using well established procedures, or automated chemical synthesis can be performed using one of a number of commercially available machines. Accordingly, the genes can be tailored for optimal gene expression based on optimization of nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell where sequence information is available.

"Coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The "3' non-coding sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor.

"RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA (mRNA)" refers to the RNA that is without introns and that can be translated into protein by the cell. "cDNA" refers to a double-stranded DNA that is complementary to and derived from mRNA. "Sense" RNA refers to RNA transcript that includes the mRNA and so can be translated into protein by the cell. "Antisense RNA" refers to a RNA transcript that is complementary to all or part of a target primary transcript or mRNA and that blocks the expression of a target gene (U.S. Pat. No. 5,107,065; WO 9928508). The complementarity of an antisense RNA may be with any part of the specific gene transcript, i.e., at the 5' non-coding sequence, 3' non-coding sequence, or the coding sequence. "Functional RNA" refers to antisense RNA, ribozyme RNA, or other RNA that is not translated yet has an effect on cellular processes.

The term "operably linked" refers to the association of nucleic acid sequences on a single nucleic acid fragment so that the function of one is affected by the other. For example, a promoter is operably linked with a coding sequence when it is capable of affecting the expression of that coding sequence (i.e., the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragments of the invention. Expression may also refer to translation of mRNA into a polypeptide.

"Transformation" refers to the transfer of a nucleic acid fragment into the genome of a host organism, resulting in genetically stable inheritance. Host organisms containing the transformed nucleic acid fragments are referred to as "transgenic" or "recombinant" or "transformed" organisms.

The terms "plasmid", "vector" and "cassette" refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with an appropriate 3' untranslated sequence into a cell. "Transformation cassette" refers to a specific vector containing a foreign gene and having elements in addition to the foreign gene that facilitate transformation of a particular host cell. "Expression cassette" refers to a specific vector containing a foreign gene and having elements in addition to the foreign gene that allow for enhanced expression of that gene in a foreign host.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.* 215:403-410 (1990); and 3.) DNASTAR (DNASTAR, Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters which originally load with the software when first initialized.

Standard recombinant DNA and molecular cloning techniques used herein are well known in the art and are described by Sambrook, J., Fritsch, E. F. and Maniatis, T., *Molecular Cloning: A Laboratory Manual*, $2^{nd}$ ed., Cold Spring Harbor Laboratory: Cold Spring Harbor, N.Y. (1989) (hereinafter "Maniatis"); by Silhavy, T. J., Bennan, M. L. and Enquist, L. W., *Experiments with Gene Fusions*, Cold Spring Harbor Laboratory: Cold Spring Harbor, N.Y. (1984); and by Ausubel, F. M. et al., *Current Protocols in Molecular Biology*, published by Greene Publishing Assoc. and Wiley-Interscience (1987).

Principle of the Recombinogenic Extension Method Using Unpaired Primers

Figure 1:
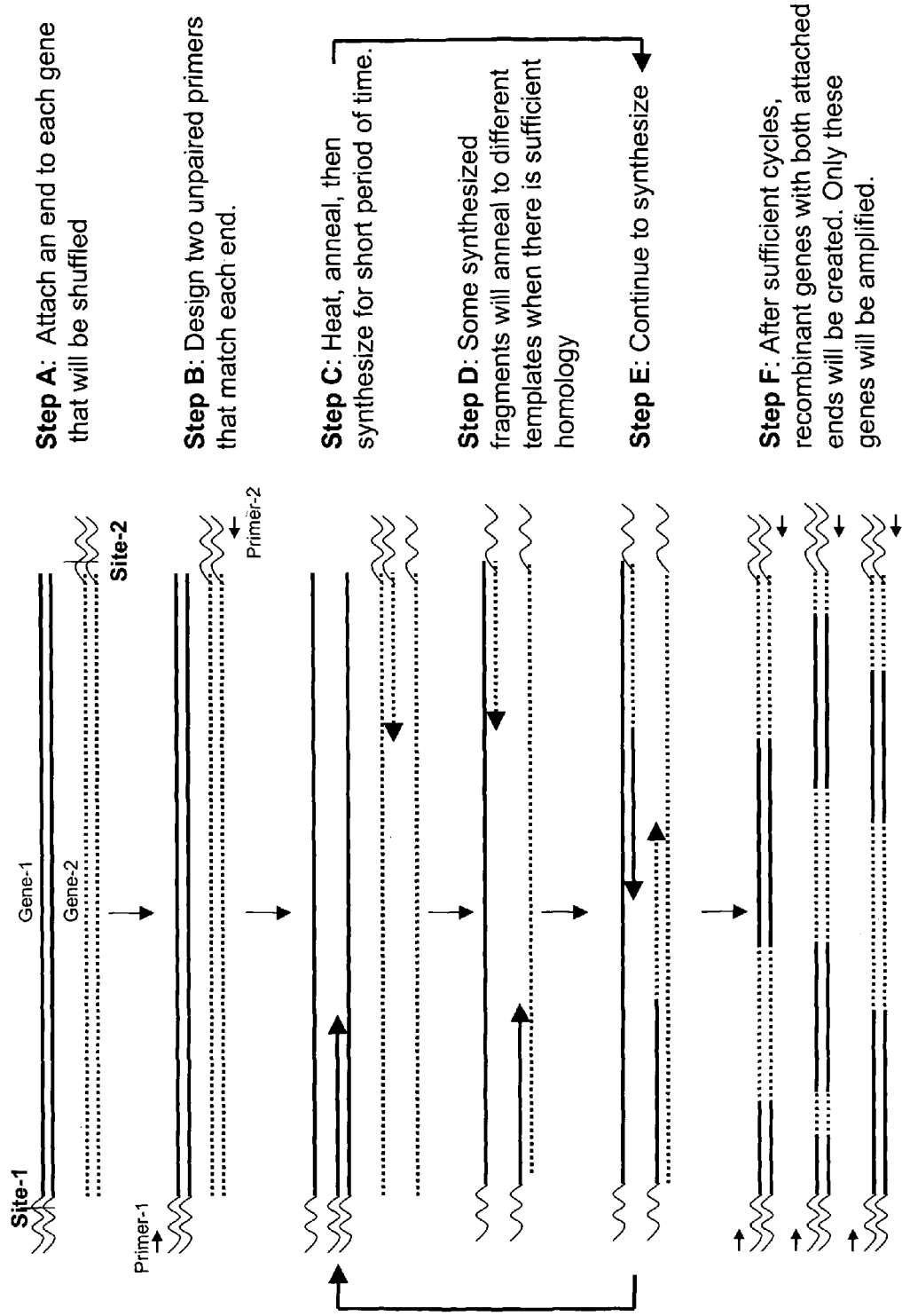
FIG. 1 shows the principle of the recombinogenic extension method using unpaired primers.

FIG. 1 illustrates the principle of the recombinogenic extension method using unpaired primers, based on recombination of two genes. This method requires that the parent genes have different DNA sequences at their 5' and 3' ends. If the parent genes have the same 5' and 3' sequences, a short flanking DNA fragment must be attached to the 5' or 3' end of the genes by standard PCR (as shown in step A of FIG. 1).

Then, the PCR products can be used as templates for the recombinogenic extension method, following the design of two unpaired primers for the thermal cycling. Primer-1 anneals with the 5' end of template-1 (the 3' region of the antisense strand), but does not bind with the 5' end of template-2. Primer-2 anneals with the 3' end of template-2 (the 3' region of the sense strand), but does not bind to the 3' end of template-1 (step B). This ensures that neither of the parent templates can be amplified by the thermal cycling reaction.

Short annealing and synthesis cycles are performed, thereby creating a series of short DNA fragments (step C). With sufficient homology, some of these DNA fragments will anneal to a different template (i.e., "template switching") in a subsequent annealing cycle (step D). Subsequently, recombinant DNA fragments will be made as shown in FIG. 1. Eventually, recombinant DNA genes with the 5' end of template-1 and the 3' end of template-2 will be created (step E).

At this time, previously unpaired primer-1 and primer-2 become paired primers for the newly created recombinant genes. Further annealing and synthesis cycles will amplify the pool of recombinant DNA genes with the 5' end of template-1 and 3' end of template-2 (step F of FIG. 1). During the amplification step, the recombinant DNA genes can be further recombined which will increase the number of crossover of the recombinant DNA genes. Theoretically, all of the amplified products should be recombinant DNA products. These recombinant products can be derived directly from the parental template molecules, or additional mutations (e.g., insertions, deletions, substitutions) may be incorporated into the final recombinogenic product. The contamination of the parent templates in the final reaction mixture is negligible.

It will be appreciated by those skilled in the art that following gene assembly (and, if necessary, conversion to double-stranded form), recombined genes could be optionally amplified prior to any method applied for screening of the expressed gene products. Additionally, it will be apparent to those skilled in the art that the unpaired primers method of the present invention could be repeated, using the recombinogenic products of the first reaction as the template molecules in a second reaction, and so forth. In this fashion, it would be expected that the "molecular evolution" so created by this process would yield a large pool of recombinogenic products, from which could be isolated a novel enzyme with the desired functionality.

In additional embodiments of the invention: 1.) primer-1 and primer-2 can be of identical sequence; 2.) unique restriction enzyme sites may be incorporated into the flanking DNA sequences ensuring that the final recombinogenic mutant library is devoid of all parent templates; and 3) enzymatic nicking of template molecules prior to recombinogenic extension may be used to increase recombinogenic efficiency.

DNA Templates

The present invention requires at least two nucleic acid templates for recombination, although a pool of many nucleic acid templates are preferred. The source of these template molecules is not critical and can therefore include nucleic acids derived from any source including microbial sources (e.g., bacterial, yeast, fungi or algae), as well as from plant, animal or human sources and may have medical, veterinary, environmental, nutritional or industrial significance. Additionally, the template molecules can be produced synthetically. The nucleic acids may be single- or double-stranded, therefore comprising ssDNA, dsDNA, cDNA, or RNA. Some previous DNA shuffling methods are limited by employing only double-stranded molecules as templates. Where the template is single-stranded it is generally obtained from a double-stranded molecule and the strand will be in either the sense or antisense orientation.

A preferred embodiment of the invention enables recombination between genes containing point mutations or allelic variants; however, percent identity between template molecules can be as little as at least 50%, where a percent identity of at least 70% is preferred and a percent identity of at least 90% is most preferred. There is no requirement that the template molecules contain homology at either their 5' or 3' ends, since the methodology of the present invention uses unpaired primers. The method is particularly useful for recombining genes for which no sequence information is available, since it is possible to engineer functional 5' and 3' amplification primers which are suitable.

The unpaired primer reaction is independent of the length of the template molecules. Thus, template molecules are not expected to be limited in length, beyond the limitations inherent to polymerases for nucleic acid extension. In contrast, the template molecules should not be shorter than about 30 nucleotides. This small size does permit application of this methodology to peptide engineering. Thus, it is contemplated that the present invention is suitable for recombination of template molecules that range in size from about 0.03-20 kB; more preferred from about 0.1-10 kB; and most preferably from about 0.2-5 kB.

The template molecules of the present invention may be linear or circular or a combinaton thereof; a specific nucleic acid fragment may be isolated from flanking regions of DNA (e.g., an isolated gene sequence) or the specific nucleic acid fragment may be flanked by other nucleotide sequences (e.g., a gene or operon cloned into a vector).

In another embodiment of the invention, the template molecules may be nicked with an enzyme. Nicking of a double-stranded template results in the breakage of one strand of the molecule where the complementary strand remains intact. Where the molecule is RNA, RNAse enzymes are suitable for nicking. Where the molecule is DNA, DNAse, DNA gyrase and recA are suitable enzymes for nicking. Template nicking introduces sufficient nicking sites into the template molecules (without leading to template fragmentation), to thereby increase the recombinant efficiency observed in mutants produced by the unpaired primer method (as opposed to mutants created using untreated templates).

Attachment of Flanking DNA Sequences to the Template

In the case of template molecules that do have significant homology at either their 5' or 3' ends, a template molecule can be engineered to contain a short specific non-native 5' or 3' sequence in the form of a short DNA fragment, such that the 5' region of the first nucleic acid template is of different sequence than the 5' region of the second template and the 3' region of the first nucleic acid template is of different sequence than the 3' region of the second template (as shown in FIG. 1). It is preferred that this flanking DNA sequence does not have any sequence basis in the template molecules. In other words, the flanking DNA sequence is not able to anneal to the template molecules during the thermocycling reaction. Flanking DNA sequences can be generated using standard PCR. As is well known in the art, paired primers may be synthesized which contain sequences at their 5' ends that have no complement in the target (5' overhang or 5' mismatch). This 5' overhang or 5' mismatch can be used to extend the length of the replicated nucleic acid products by adding extra sequences, e.g., the flanking DNA sequences.

Once it is possible to distinguish one template molecule on the basis of a 5' region and a second template molecule on the basis of a 3' region, then a forward and reverse unpaired primer set (which meets the requirements as described below) can be designed to anneal specifically to these flanking sequences.

It is important to note that neither the particular length or sequence of these 5' or 3' flanking regions is critical to the invention. However, the design of these flanking regions requires that the fragment must be of sufficient length and possess sufficient nucleotide sequence uniqueness (with respect to the template molecule) for the design of a unique primer that will anneal to a single region of the template. These requirements permit some variability. Typically, short 5' or 3' flanking DNA regions are approximately 6-200 bases in length, with approximately 10-100 bases being preferred. Longer non-native sequences offer little advantage and increase the final size of the recombinogenic molecules that must be synthesized.

With respect to the specific sequences of these flanking DNA regions, it is possible to attach two similar flanking DNA fragments (distinguished only by their internal "middle" sequence) to the 5' ends of two templates. A forward primer (primer-1) could be designed to anneal to the internal "middle" sequence of the flanking DNA sequence attached to template-1. Since the middle sequence of the flanking DNA sequence attached to template-2 is different, primer-1 cannot anneal to template-2. A similar situation could be generated for the 3' ends of template-1 and template-2. Thus, in this example, despite sequence similarity in the flanking DNA fragments, it is still possible to create unpaired primers. Following the discussion above, it will be apparent to one skilled in the art that the 5' and 3' ends of two templates molecules can be the same or different. Either embodiment is possible, if an internal region is utilized for primer annealing.

In an alternative embodiment, it is possible to design these DNA flanking sequences in such a manner that the forward primer and reverse primer would be of identical sequence. This would require that a portion of the flanking sequence attached to template-1 would be complementary to a portion of the flanking sequence attached to template-2. Of course, each template will be primed for synthesis only at either the 5' or 3' region of the molecule (thus ensuring subsequent creation of unpaired primers).

In a preferred embodiment, in order to further minimize the presence of parent template DNA in the final pool of recombinogenic products, it is possible to design the 5' and 3' flanking DNA sequences attached to the template molecules so that each contains a unique restriction site. In other words, the 5' flanking region would have a nucleotide sequence comprising a first unique restriction site (e.g., RE site 1); in like manner, the 3' flanking region would contain a second unique restriction site, different than the first restriction site (e.g., RE site 2). Following the unpaired primer reaction, the full-length extension products so produced could be digested with the particular restriction enzymes corresponding to RE site 1 and RE site 2 (i.e., RE-1 and RE-2). Only those products which were produced by recombination and extension from the original unpaired primers would be cleaved by these restriction enzymes (i.e., RE-1 and RE-2) and be suitable for ligation into an expression vector, similarly cleaved with RE-1 and RE-2 corresponding to RE site 1 and RE site 2 (or cleaved with restriction enzymes compatible with RE-1 and RE-2). Parent template molecules would not be cloned in this process and would therefore be excluded from subsequent screening processes, thereby saving time and money. Thus, this strategy would further reduce the parental contamination to zero.

Primers

A distinguishing element of the present invention is the unpaired nature of the primers. In the case of two parent template molecules in a recombinogenic reaction, the forward primer anneals to the 5' region of the first template molecule (the 3' region of the antisense strand), but must not anneal to the 5' region of the second template molecule. In like manner, the reverse primer must anneal with the 3' region of the second template molecule (the 3' region of the sense strand), but must not anneal to the 3' region of the first template molecule. Stated in another manner, the unpaired primers method requires that each template molecule present in the reaction can only have a single primer anneal to that particular template (i.e., either the forward or reverse primer). In no case may both the forward and reverse primer anneal to a single template molecule, since this becomes a set of paired primers.

Of course, when more than two unique template molecules are present in the initial reaction mixture, the goal is to have a forward primer that binds to 5-95% of the template molecules and a reverse primer that anneals to the remaining template molecules. This unique design of "unpaired" primers is essential for minimization of contamination of the parent templates in the final recombinogenic reaction mixture.

The specific sequences of the primers can be 100% complementary to the 5' region of the first template molecule or 3' region of the second template molecule; or, the sequence can be slightly mismatched. The degree of mismatch depends on the overall length of the primer sequence, with preferred primers ranging in length from approximately 6 to 200 nucleotides. However, any mismatch in a primer sequence must not be so great as to prohibit the primer's ability to participate in primer directed extension. It is further preferred if the unpaired primers not have significant homology to any internal nucleotide sequences within the template molecules.

In an alternate embodiment, the forward and reverse primers may have identical sequences (e.g., a single primer is utilized that serves as both forward and reverse primers). This would be possible, for example, if a template gene(s) was cloned into a vector in both forward and reverse orientations.

Thus, the vector forward primer would amplify the sense strand of the gene when it was cloned in one orientation, while the same vector primer would also amplify the antisense strand of the gene when the gene was cloned in the opposite orientation.

In all cases, the primer must be able to anneal specifically to its target region on a specific template molecule during the annealing step of the thermal cycling reaction. The variables which affect primer annealing are well known in the art and are discussed by Rychlik, W. (PCR Protocols: Current Methods and Application. In, Methods in Molecular Biology, Vol. 15, pp 31-40; White, B. A, ed.; Humana: NJ (1993)). Annealing temperature can be estimated by first determining the melting temperature (Tm) of the primer. A variety of methods are known in the art to calculate Tm, such as the following:

1. An estimate of Tm (for primers less than 25 nucleotides in length) can be determined based on the base composition of the primer $(4\times(\#C+\#G)+2\times(\#A+\#T))° C.$, as described in Thein and Wallace ("The use of oligonucleotide as specific hybridization probes in the Diagnosis of Genetic Disorders", in Human Genetic Diseases: A Practical Approach, K. E. Davis ed., (1986) pp. 33-50 IRL: Herndon, Va.). This formula gives a very approximate Tm in the absence of denaturing agents such as formamide.
2. A more sophisticated method of calculating annealing temperatures is based on the following formula for Tm, where $Tm=81.5+[16.6\times(\log_{10}[Na+])]+0.41\times(\%_{G+C})-675/n$. Notations: [Na+] is the molar salt concentration; [K+]=[Na+]; and n=number of bases in the oligonucleotide.

Of course, optimal annealing temperatures can only be determined experimentally for a certain primer/template combination. It is important that the optimal annealing temperature be correctly identified, to enable recombination by the unpaired primers method.

Some simple rules are useful in selection and design of the primers. Typically, in preferred reactions, primers will be about 10 to 35 base pairs in length having a 50-60% G+C composition. Depending on the selected conditions, Tm's between 50° C. and 80° C. are suitable. In addition to the Tm's, the complementarity at the 3' end of the primers is an important consideration. Generally, complementarity of primer pairs should be avoided, especially at the 3' ends. Also, consecutive runs of C's and G's (3 or more) at the 3' ends of the primers along with palindromic sequences should be avoided. Consideration should also be given to the concentration of primer molecules in the replication milieu. Primer concentrations between 0.01 and 1.0 µM are generally suitable, with concentrations of about 0.05 to 1.0 µM being optimal.

The methodology of the present invention contemplates the recombining of nucleic acid molecules in a random or biased fashion. This differentiation is based on primer design and the template concentration. Specifically, if random recombining is desired throughout the length of all template molecules, then two separate unpaired recombinogenic reactions should be prepared. The first reaction would contain forward primer Primer-1 (which would anneal with the 5' region of the first template molecule, but not anneal to the 5' region of the second template molecule) and reverse primer Primer-2 (which would anneal with the 3' region of the second template molecule, but not anneal to the 3' region of the first template molecule). Conversely, the second unpaired recombinogenic reaction would contain forward primer Primer-3 (which would anneal with the 5' region of the second template molecule, but not anneal to the 5' region of the first template molecule) and reverse primer, Primer-4 (which would anneal with the 3' region of the first template molecule, but not anneal to the 3' region of the second template molecule). Following creation of recombinogenic molecules from each reaction (and optionally, amplification), the two reactions could be mixed together to ensure that recombination occurred in a random fashion that was not dependent on the particular template to which the unpaired primers were designed for annealing.

Biased recombination, which may concentrate recombination within or away from a specific region, may be promoted by choice of primers. Specifically, if one desires to minimize recombination in the 5' region of the first template molecule, and maximize recombination in the 3' region of the first template molecule, one can: 1.) design a single reverse primer that anneals with the 3' region of the first template molecule; and 2.) design one or more forward primer(s) which anneal to the remaining template molecules (a pool of templates, excluding the first template molecule). As a result, a biased mutant library will be obtained, in which recombinant mutants will not contain the 5' region sequence of the first template molecule, but will contain the 3' region sequence of the first template molecule.

A random or biased recombination may also can be obtained by adjusting the template concentrations. For example, the equal molar ratio of templates could be used for a random recombination. For biased recombination, a biased molar ratio of templates could be used. In this situation, the template with lower concentration will be minimized in the recombinant library, and the template with the higher concentration will be maximized in the library.

Primer Extension Methods for Creation of Full-length Extension Products Using Unpaired Primers Polymerase enzymes are a necessary component in any primer directed extension method and are used to successively add nucleotides to the nucleic acid strand being created by replication. A variety of DNA and RNA polymerases are common and well known in the art, each of which can be evaluated on the basis of nuclease activity, thermostability, processivity, strand displacement activity, and fidelity. A useful review of DNA polymerases can be found in Hamilton, S. C. et al. (*BioTechniques*, 31(2):370-383 (2001)). Polymerases of the invention will include those that function in a variety of primer directed replication methods including Polymerase Chain Reaction (PCR), Ligase Chain Reaction (LCR) and Strand Displacement Amplification (SDA), all of which are discussed in more detail below.

Polymerases useful in the invention will include both those that give high fidelity of replication as well as those that introduce errors into the replicated template. The use of such error prone polymerases may serve to enhance the effectiveness of the present recombinogenic method.

It is well known in the art that mutations and/or crossovers can be introduced at the DNA level by using different DNA-dependent DNA polmerases, or even directly from mRNA by using different RNA-dependent polymerases. Numerous studies (reviewed in Echols, H. and M. R. Goodman, *Annu. Rev. Biochem.* 60:477-511 (1991); Roberts, J. D. and T. A. Kunkel, in DNA Replication in Eukaryotic Cells: Concepts, Enzymes & Systems (De Pamphilis, M., Ed.), pp 217-247, Cold Spring Harbor Laboratories: Cold Spring Harbor, N.Y. (1996); and Johnson, K. A., *Annu. Rev. Biochem.* 62:685-713 (1993)) have shown that two events initiate most polymerization errors. One is the misinsertion of an incorrect nucleotide. This usually yields a base substitution mutation, but can also yield a frame-shift when the misinserted nucleotide is complementary to an adjacent template base and the primer relocates to produce misaligned strands. Several steps in the reaction cycle can affect the rate of errors initiated by misinsertion, such as: dNTP binding, a subsequent conformational change preceding chemistry, rate of phosphodiester bond formation, and the balance between extension of a misinserted base and its exonucleolytic removal or rearrangement. The second error-initiating event is template-primer slippage (reviewed in Roberts and Kunkel, supra), usually resulting in deletion or addition of one or more nucleotides, particularly in repetitive sequences.

Error rates of thermal resistant DNA polymerases have been estimated for:

Taq (*Thermus aquaticus*): ranging from $2.4 \times 10^{-5}$ frameshift mutations/bp (Tindall, K. R. and T. A. Kunkel. *Biochemistry* 27:6008-6013 (1988)) to $2.1 \times 10^{-4}$ errors/bp (Keohavang, P. and W. G. Thilly. *Proc. Natl. Acad. Sci. USA* 86(23):9253-9257 (1989));

KlenTaq (*Thermus aquaticus*, N-terminal deletion mutant): $5.1 \times 10^{-5}$ errors/bp (Barnes, W. M. *Gene* 112 (1):29-35 (1992));

Vent (*Thermococcus litoralis*): ranging from $2.4 \times 10^{-5}$ errors/bp (Cariello N. F., et al. *Nucl. Acids Res.* 19(15): 4193-4198 (1991)) to $5.7 \times 10^{-5}$ errors/bp (Matilla, P. et al. *Nucl. Acids Res.* 19(18):4967-4973 (1991));

Vent (exo−) (*Thermococcus litoralis*): $1.9 \times 10^{-4}$ errors/bp (Matilla et al., supra);

Deep Vent (Pyrococcus species GB-D): No published literature; New England Biolabs (Beverly, Mass.) claims fidelity is equal to or greater than that of Vent;

Deep Vent (exo−) (Pyrococcus species): No published literature;

Pfu (*Pyrococcus furiosus*): $1.6 \times 10^{-6}$ errors/bp (Lundberg et al. *Gene* 108(1):1-6 (1991)); and Replinase (*Thermus flavis*): $1.03 \times 10^{-4}$ errors/bp (Matilla et al., supra).

Additionally, mutant derivatives of polymerases are also known which can substantially increase misinsertion rate, relative to the wild-type polymerase (e.g., the mutant derivative of Klenow fragment DNA polymerase, described in Carroll, S. S. et al. *Biochemistry* 30: 804-813 (1991)).

Thermal Cycling Conditions

One important element of the present invention is the use of low annealing temperatures (preferably for short times) and short synthesis cycles (preferably at low temperatures). Either a 3-step or a 2-step thermal cycle can be used. For a 2-step cycle, the annealing and polymerase-catalyzed extension elements of the thermocycling reaction are compressed into a single, abbreviated step. During primer extension, it is extremely important that the primer is able to tolerate some nonspecific priming, thus increasing the recombination efficiency. The use of low annealing temperatures will accomplish this purpose. Another important aspect of the method is the use of a short, abbreviated annealing/extension step. This will also facilitate recombination. This phenomenon was first documented by Judo, M. S. B. et al. (*Nucleic Acids Res.* 26(7): 1819-1825 (1998)) in their examination of the stimulation and suppression of PCR-mediated recombination, or chimera formation. Judo et al. determined that PCR cycling programs designed to specifically favor incomplete extension/elongation and subsequent priming of those incompletely extended products via template strand exchange could stimulate high levels of genetic recombination. Thus, this step is important to ensure that primer directed extension occurs for a very short period of time, with termination of primer extension after addition of no more than about 1000 nucleotides, or more preferably about 100-300 nucleotides, or most preferably about 20-50 nucleotides. Termination of primer extension may be accomplished by a variety of methods including, but not limited to: either raising or lowering the temperature, altering the pH of the reaction mixture, or by adding various reagents that serve to inhibit the polymerase.

The next cycle of denaturation occurs immediately following termination of primer extension, and functions to denature the template and partially extended primer product. In the following cycle of annealing/extension, the partially extended primer product is able to anneal to a different template molecule and complete another short cycle of primer directed extension.

Primer Directed Amplification of Full-length Extension Products Using Paired Primers The present method optionally provides for the amplification a recombinogenic nucleic acid molecule. A variety of nucleic acid amplification methods are known in the art including thermocycling methods such as polymerase chain reaction (PCR) and ligase chain reaction (LCR), as well as isothermal methods and strand displacement amplification (SDA). Additional methods of RNA replication such as the replicative RNA system (e.g., Qβ-replicase) and DNA dependent RNA-polymerase promoter systems (e.g., T7 RNA polymerase) are contemplated to be within the scope of the present invention.

For the purposes of the present invention, these methodologies for primer directed amplification of the full-length recombinogenic extension products may optionally utilize the original "unpaired" primers that were specifically designed to anneal to the parent templates. However, following recombination, these primers effectively became "paired" primers for the recombinogenic products. Or, new primers may be designed for efficient and faithful replication of the full-length recombinogenic extension products.

Polymerase Chain Reaction

Typically, in PCR-type amplification techniques, the paired primers have different sequences and are not complementary to each other. Methods of PCR primer design are common and well known in the art (see, Thein and Wallace, "The use of oligonucleotide as specific hybridization probes in the Diagnosis of Genetic Disorders", in *Human Genetic Diseases: A Practical Approach*, K. E. Davis Ed., (1986) pp 33-50, IRL: Herndon, Va.); and Rychlik, W. In, *Methods in Molecular Biology*, PCR Protocols: Current Methods and Applications. White, B. A., Ed. (1993), Vol. 15, pp 31-39, Humania: Totowa, N.J.).

Ligase Chain Reaction

When the ligase chain reaction (LCR) is used for replication of a pool of double-stranded recombinogenic nucleic acids, two sets of target-specific primers are required. The members of one set of primers are complementary to adjacent sequences found on a given strand of the target, while the members of the second set are complementary to adjacent sequences on the opposite strand. In this way, a set of adjacent primers is specific for each target strand. During the replication process, the target nucleic acid is heated to denature the two target strands. The four complementary oligonucleotide primers comprising the two primer sets are then hybridized near their melting temperature to the separated target strands. A thermal-stable ligase will covalently attach the adjacent primers on each target strand. Only adjacent primers that are perfectly complementary to the target will be ligated together. In this way, the products from the first stage of ligation become targets for the next round of ligation. The products thus increase exponentially with continued cycles of target denaturation, primer hybridization and ligation steps.

The requirements for non-complementarity between primers, size, base composition and melt temperature of the primers tend to be similar to those stated above for PCR replication. Generally, primers for LCR replication should be sufficiently long so that each will preferentially bind to its specific binding site on the target nucleic acid. To ensure specificity of ligation, reactions can be carried out near the melting temperature (Tm) of the oligonucleotide primers. At higher temperatures, destabilization of the terminal bases at the junction between adjacent primers can form. This results not only in an imperfect double helix but in a lower ligation rate.

Strand Displacement Amplification

Strand displacement amplification (SDA) offers an isothermal alternative to PCR for the amplification of recombinogenic nucleic acids and may be used to amplify either a single-stranded or double-stranded target. Materials necessary for SDA amplification include either one or two short primers containing an asymmetric restriction enzyme site, such as HincII, an exonuclease-deficient DNA polymerase, HincII restriction enzyme and the bases dGTP, dCTP, dTTP and deoxyadenosine 5' [α-thio]triphosphate (dATP[αS]).

If the target to be amplified is single-stranded, a single primer is used which binds to the target at its complementary 3' end forming a duplex with a 5' overhang at each end. The 5' overhang strand of the primer contains a recognition sequence for the restriction enzyme, HincII. An exonuclease-deficient DNA polymerase I extends the ends of the duplex using dGTP, dCTP, TTP and dATP[αS], which produces a hemiphosphorothioate recognition site. HincII nicks the unprotected primer strand of the hemiphosphorothioate site leaving intact the modified complementary strand. The exopolymerase extends the 3' end at the nick and displaces the downstream complement of the target strand. The polymerization/displacement step regenerates a nickable HincII recognition site. Nicking and polymerization/displacement steps cycle continuously, producing a linear amplified single-stranded product of the target strand.

If a nucleic acid target is to be exponentially amplified, then two primers are used each having regions complementary to only one of the stands in the target. After heat denaturation, the single-stranded target fragments bind to the respective primers which are present in excess. Both primers contain asymmetric restriction enzyme recognition sequences located 5' to the target binding sequences. Each primer-target complex cycles through nicking and polymerization/displacement steps in the presence of a restriction enzyme, a DNA polymerase and the three dNTP's and one dNTP[αS] as discussed above. An in-depth discussion of SDA methodology is given by Walker et al. (*Proc. Natl. Acad. Sci. U.S.A.*, 89:392 (1992)).

Protein Expression and Screening for Altered Properties

After the recombined gene or nucleic acid sequence has been recombined it will be useful to insert it into an expression vector for:

1.) expression in a suitable host cell of the recombined polypeptides; and
2.) the screening of the polypeptide for altered properties.
   Typical host cells will be microbial (bacterial, yeast or fungi) and plant cell systems (including whole plants and plant tissue culture systems).

Development of Microbial and Plant Screens

Assays used for screening recombinogenic molecules must be robust, sensitive, specific and able to operate above a background of potential interferences from a number of sources. Assay technologies are typically examined with particular reference to the high throughput screening environment, since high throughput (HTP) screening often uses DNA chips or micro-arrays and automated data processing for large-scale screening, to expedite the screening processes.

Common techniques used for screening activity of recombinogenic molecules expressed in host systems include: mass spectrometry, bioassays, immunochemical assays, chemical assays, and biochemical assays. It is desirable to develop screens that permit rapid analysis of results. Particularly desirable microbial screening systems are based on the ability of a recombinant microorganism to grow on a particular medium or under particular conditions, as a method to select those recombinant organisms exhibiting a preferred property (e.g., methods based on resistance, substrate utilization, or temperature stability).

Microbial Expression Systems

Microbial expression systems and expression vectors containing regulatory sequences that direct expression of foreign proteins are well known to those skilled in the art. Any of these could be used to test recombinogenic molecules produced by the unpaired primers method described herein. These chimeric genes could then be introduced into appropriate microorganisms via transformation to allow for expression of the enzymes.

Vectors or cassettes useful for the transformation of suitable microbial host cells are well known in the art. Typically the vector or cassette contains sequences directing transcription and translation of the relevant gene, a selectable marker, and sequences allowing autonomous replication or chromosomal integration. Suitable vectors comprise a region 5' of the gene (i.e., the full-length recombinogenic extension product) which harbors transcriptional initiation controls and a region 3' of the recombinogenic product which controls transcriptional termination. It is most preferred when both control regions are derived from genes homologous to the transformed host cell, although it is to be understood that such control regions need not be derived from the genes native to the specific species chosen as a production host.

Initiation control regions (or promoters) which are useful to drive expression of the recombinogenic products in the desired host cell are numerous and familiar to those skilled in the art. Virtually any promoter capable of driving these genes is suitable for the present invention including, but not limited to: CYC1, HIS3, GAL1, GAL10, ADH1, PGK, PHO5, GAPDH, ADC1, TRP1, URA3, LEU2, ENO, TPI (useful for expression in Saccharomyces); AOX1 (useful for expression in Pichia); and lac, trp, $IP_L$, $IP_R$, T7, tac, and trc (useful for expression in *Escherichia coli*).

Termination control regions may also be derived from various genes native to the preferred hosts. Optionally, a termination site may be unnecessary; however, it is most preferred if included.

Plant Expression Systems

Overexpression of the full-length recombinogenic products synthesized by the present invention may also be accomplished in plant hosts. This is achieved by first cloning the recombinogenic genes into vectors, such that the coding regions are operably linked to promoters capable of directing expression of the gene in the desired tissues at the desired stage of development. 3' Non-coding sequences encoding transcription termination signals must also be provided.

The choice of plasmid vector depends upon the method that will be used to transform the host plants. The skilled artisan is well aware of the genetic elements that must be present on the plasmid vector in order to successfully transform, select and propagate host cells containing the recombinogenic genes. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA blots (Southern et al., *J. Mol. Biol.* 98:503 (1975)), Northern analysis of mRNA expression (Kroczek, *J. Chromatogr. Biomed. Appl.,* 618:133-145 (1993), Western analysis of protein expression, enzymatic activity analysis of expressed gene products, and/or phenotypic analysis.

Any combination of any promoter and any terminator capable of inducing expression of a coding region may be used with the recombinogenic genetic sequence. Some suitable examples of promoters and terminators include those from nopaline synthase (nos), octopine synthase (ocs) and cauliflower mosaic virus (CaMV) genes. One type of efficient plant promoter that may be used is a high level plant promoter. Such promoters, in operable linkage with the genetic sequences of the present invention, should be capable of promoting expression of the present gene products. High level plant promoters that may be used in this invention include, for example, the promoter of the small subunit (ss) of the ribulose-1,5-bisphosphate carboxylase from soybean (Berry-Lowe et al., *J. Molecular and App. Gen.* 1:483-498 (1982)) and the promoter of the chlorophyll a/b binding protein. These two promoters are known to be light-induced in plant cells (see for example, Cashmore, A. *Genetic Engineering of Plants, an Agricultural Perspective*; Plenum: NY, 1983; pp 29-38; Coruzzi et al., *J. Biol. Chem.* 258:1399 (1983); and Dunsmuir et al., *J. Mol. Appl. Genetics* 2:285 (1983)).

For some applications it will be useful to direct the gene products of the recombinogenic genes to different cellular compartments. It is thus envisioned that vector constructs containing the chimeric genes described above may be further supplemented by addition of appropriate intracellular targeting sequences such as transit sequences (Keegstra, K., *Cell* 56:247-253 (1989)), signal sequences, or sequences encoding endoplasmic reticulum localization (Chrispeels, J. J., *Ann. Rev. Plant Phys. Plant Mol. Biol.* 42:21-53 (1991)) or nuclear localization signals (Raikhel, N., *Plant Phys.* 100: 1627-1632 (1992)) added and/or with targeting sequences that are already present removed. While the references cited give examples of each of these, the list is not exhaustive and more targeting signals of utility may be discovered in the future that will be useful in the present invention.

Recombined Polypeptides

The genetic templates of the invention may be obtained from any source and have applications in broad areas of research and industry including medicinal, veterinary, environmental, nutritional or agronomic fields. Polypeptides of the invention, encoded by these templates may be enzymes, toxins, cytokines, glycoproteins and growth factors having therapeutic significance. In the agronomic and nutritional area specific examples of useful polypeptides that could be recombined and altered by the invention include, but are not limited to: 1.) enzymes for primary or secondary metabolism in plants (e.g., phenylalanine ammonia-lyase, cinnamyl alcohol dehydrogenase, o-methyltransferase, cinnamate 4-hydroxylase, 4-coumarate-CoA ligase, and cinnamoyl CoA reductase gene—all of which function in lignin biosynthesis [A. M. Boudet et al., *New Phytol.,* 129:203 (1995)]; 2.) proteins that confer disease resistance (e.g., gene for endotoxin of *Bacillus thuringiensis*, WO 92/20802), or herbicide resistance (e.g., mutant acetolactate synthase, WO 92/08794); and 3.) proteins with desired properties useful in animal feed or human food, including seed storage proteins (e.g., the high-sulfur 10 kD corn seed protein or high-sulfur zein proteins and the glutelin polypeptide, WO 93/18643). Additionally, it is recognized that polypeptides having industrial significance may also be recombined and enhanced by the present method including, for example: 1.) industrial enzymes from thermophiles and mesophiles (e.g., proteases, esterases, pectinases, xylanases, amylases, cellulases, levanases, lipases, RNases, nucleotidases, transfructosylases, lactases, desaturases, dehydrogenases, oxidases, transferases, isomerases, dehydratases, desulfurases, hydratases, phosphatases, kinases and glucose isomerase phosphatases); 2.) biotin binding proteins (e.g., avidin and streptavidin); 3.) immunoglobin binding proteins (e.g., protein A, protein G and protein L); 4.) immunoglobins, receptor proteins, and structural proteins (e.g., actin, fibrin, collagen, silk proteins and elastin); 5.) viral proteins (e.g., protease reverse transcriptase, and envelope proteins); and 6.) antigens from microbes and protozoa (e.g., Staphylococcus protein A, levansucrase, and barnase). Many such proteins are well known to the skilled artisan. The amino acid and nucleotide sequence encoding such proteins are easily available through many computer data bases, for example, GenBank, EMBL and Swiss-Prot. Alternatively, the nucleotide or amino acid sequence of a target protein can be determined using routine procedures in the art.

DESCRIPTION OF THE PREFERRED EMBODIMENTS

Two distinct biological systems were utilized to develop and study the recombinogenic potential of the unpaired primers method. The first system involved the optimization of a phenylalanine ammonia-lyase (PAL) gene, in order to introduce greater tyrosine ammonia-lyase (TAL) activity. Mutants could thus synthesize 4-hydroxycinnamic acid (PHCA) directly from the substrate tyrosine, without the intermediacy of cinnamate.

The second system involved the development of a coenzyme $B_{12}$-dependent dehydratase having improved reaction kinetics (i.e., having an increased total turnover number in the presence of glycerol and 1,3-propanediol) for use in industrial applications, specifically for producing 3-hydroxypropionaldehyde and 1,3-propanediol. The mutant dehydratases are characterized by either having an increased $k_{cat}$ and/or a decreased rate of enzyme inactivation, relative to the wild-type enzyme from which they were created.

In both biological systems, the recombinogenic extension method using unpaired primers was found to successfully enable generation of full-length recombinogenic extension products having altered properties (e.g., enzyme activity and substrate specificity).

A Model System for Development of the Unpaired Primers Method:

The PAL/TAL Biological System

Development of the present invention was performed using genes and enzymes that related to phenylalanine ammonia-lyase (PAL) (EC 4.3.1.5) and tyrosine ammonia-lyase.

The PAL enzyme converts phenylalanine to trans-cinnamic acid, by removal of the (pro-3S)-hydrogen and $—NH_3^+$ from L-phenylalanine. Trans-cinnamic acid can subsequently be hydroxylated at the para position by cinnamate-4-hydroxylase to make PHCA (Pierrel et al., *Eur. J. Biochem.* 224:835 (1994); Urban et al., *Eur. J. Biochem.* 222:843 (1994); Cabello-Hurtado et al., *J. Biol. Chem.* 273:7260

(1998); and Teutsch et al., *Proc. Natl. Acad. Sci. USA* 90:4102 (1993)) or hydroxylated in the presence of a P450 enzyme system. Genes encoding PAL are known in the art and several have been sequenced from both plant and microbial sources (see for example EP 321488 [*Rhodosporidium toruloides*]; WO 9811205 [*Eucalyptus grandis* and *Pinus radiata*]; WO 9732023 [Petunia]; JP 05153978 [*Pisum sativum*]; WO 9307279 [potato, rice]; and for example GenBank AJ010143 and X75967). The PAL genes from various sources have been over-expressed as active PAL enzymes in yeast, *Escherichia coli* and insect cell cultures (Faulkner et al., *Gene* 143:13-20 (1994); Langer et al., *Biochemistry* 36:10867-10871 (1997); McKegney et al., *Phytochemistry* 41:1259-1263 (1996)).

Some PAL genes, in addition to their ability to convert phenylalanine to cinnamate, can accept tyrosine as the substrate. In such reactions the enzyme activity is designated tyrosine ammonia lyase (TAL). Conversion of tyrosine by TAL results in the direct formation of PHCA from tyrosine without the intermediacy of cinnamate. However, all natural PAL/TAL enzymes prefer to use phenylalanine rather than tyrosine as their substrate. The wild-type PAL/TAL enzyme from the yeast Rhodosporidium exhibits a reduced preference for phenylalanine as compared to tyrosine, having a ratio of TAL catalytic activity to PAL catalytic activity of only 0.58 (reported in Hanson and Havir, In *The Biochemistry of Plants*; Academic: New York, 1981; Vol. 7, pp 577-625). For comparison, the PAL/TAL enzymes studied in other organisms typically possess PAL/TAL ratios of 15 or greater.

U.S. Pat. No. 6,521,748 (herein incorporated by reference) developed several mutant PAL/TAL genes which possess enhanced tyrosine ammonia-lyase (TAL) activity, by mutagenesis of the wild-type *Rhodosporidium toruloides* PAL. These genes are summarized below in Table 3, according to their specific mutations and TAL/PAL ratios.

TABLE 3

Summary of Mutations Contained within Parent Template Molecules

| Strain | Mutations | TAL/PAL Ratio | Nucleotide SEQ ID NO |
|---|---|---|---|
| Wild-Type PAL | None | 0.5 | 1 |
| EP18Km-6 (mutant PAL) | CTG(Leu215) to CTC(Leu) GAA(Glu264) to GAG(Glu) GCT(Ala286) to GCA(Ala) ATC(Ile540) to ACC(Thr) | 1.7 | 3 |
| RM120-1 | GAC(Asp126) to GGC(Gly) CAG(Gln138) to CTG(Leu) CTG(Leu215) to CTC(Leu) GAA(Glu264) to GAG(Glu) GCT(Ala286) to GCA(Ala) ATC(Ile540) to ACC(Thr) | 7.2 | 5 |
| RM120-7 | TCG(Ser149) to CCG(Pro) ATC(Ile202) to GTC(Val) CTG(Leu215) to CTC(Leu) GAA(Glu264) to GAG(Glu) GCT(Ala286) to GCA(Ala) ATC(Ile540) to ACC(Thr) | 0.8 | 7 |
| RM492-1 | GTC(Val502) to GGC(Gly) CTG(Leu215) to CTC(Leu) GAA(Glu264) to GAG(Glu) GCT(Ala286) to GCA(Ala) ATC(Ile540) to ACC(Thr) | 2.0 | 9 |

These mutant genes are used as template molecules in the present invention, due to their known mutations which can be used as "molecular markers". Thus, sequencing of recombinogenic molecules permits easy assessment of genetic recombination resulting from the unpaired primers method. Additionally, overall enzyme function can readily be assessed according to the TAL/PAL ratio, to study the ability of the unpaired primers method to alter enzyme activity and substrate specificity.

The Recombinogenic Extension Method Using Unpaired Primers

Two mutant TAL/PAL genes possessing a total of three molecular markers, representing three substitutions of a specific nucleotide base, were selected as template molecules for initial experiments using the recombinogenic extension method with unpaired primers. A short flanking DNA fragment was attached to the 5' or 3' end of each parent gene, using standard PCR, to ensure that subsequent primers could be designed such that the forward primer anneals to the 5' region of the first template molecule (but not to the 5' region of the second template molecule), while the reverse primer anneals with the 3' region of the second template molecule (but not to the 3' region of the first template molecule). Primer directed extension was then conducted in a replication composition (composed of the templates, dNTPs, PCR buffer, the unpaired primers, polymerase, and water) using thermal cycling conditions which promoted denaturation and extremely abbreviated annealing/polymerase-catalyzed extension. A temperature gradient was used to find the optimal temperature for annealing/polymerase-catalyzed extension.

Figure 2:
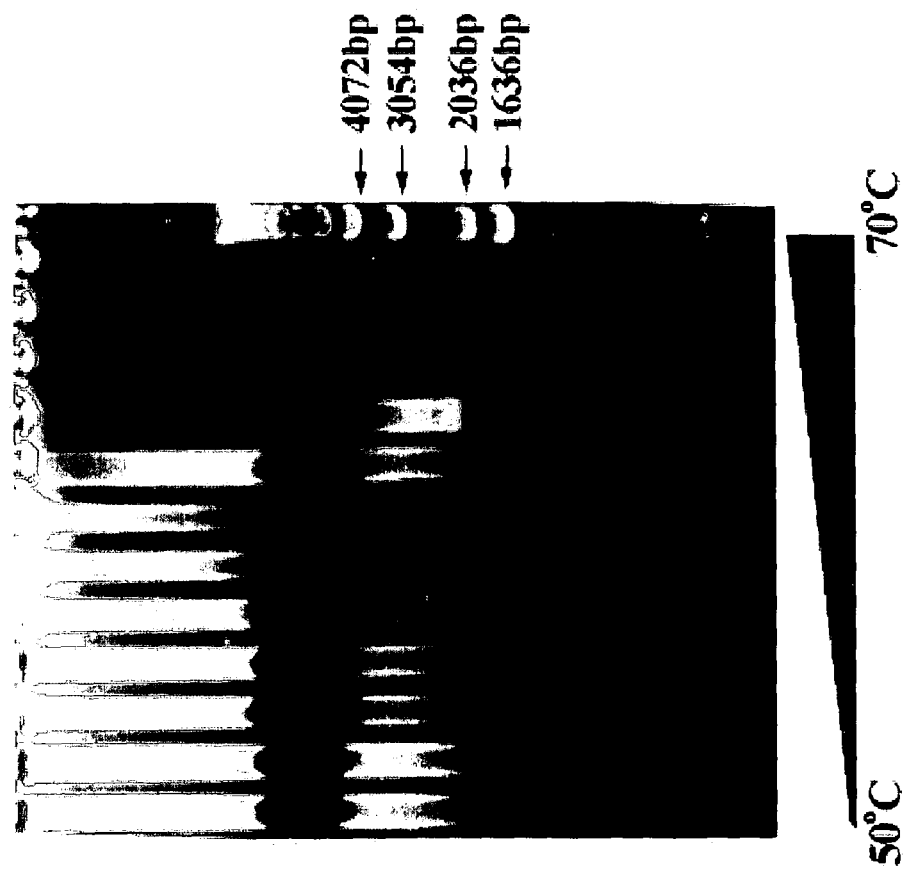
FIG. 2 is an agarose gel of the recombinogenic extension method using unpaired primers, with RM120-1 and RM492-1 as templates. The lane on the far right of the gel is a standard molecular weight marker.

Evidence of effective primer extension, thereby permitting synthesis of full-length extension products having a similar size as that of the parent templates, was evaluated by separating products of the unpaired primer reaction performed at various gradient temperatures by agarose gel electrophoresis (FIG. 2). As the temperature for annealing/polymerase-catalyzed extension gradually increased, evidence of effective primer extension was seen by the sudden appearance of a discrete band of the appropriate molecular weight (with respect to the parent templates) at the optimal temperature for annealing/polymerase-catalyzed extension.

Following the initial confirmation of full-length extension products by gel electroporesis, the recombinogenic products were then cloned into a pCR4TOPO plasmid vector and transformed into *E. coli* cells. Sequencing of those recombinogenic inserts determined that the unpaired primer method was able to produce recombinant DNA products with tremendously high efficiency (7 of 7 clones were recombinogenic).

Subsequent experimentation determined that the recombinogenic extension method using unpaired primers was also suitable to create mutant enzymes which possessed improved enzyme activity and altered substrate specificity relative to the parent templates using two template genes and also using a pool (3) of template genes. In addition to recombining the molecular markers of the parent templates, additional mutations were introduced into the recombinogenic molecules in the form of new mutations and substitutions. High throughput screening permitted screening of the expressed gene products and sequencing proved that all of the analyzed mutants were recombinant mutant genes.

Industrial Application of the Unpaired Primers Method:

Glycerol Dehydratase for Synthesis of 1,3-Propanediol

Biological methods for producing 1,3-propanediol, a starting material for production of polyesters, polyethers, and polyurethanes, requires glycerol as a substrate for a two-step sequential reaction. First, a dehydratase (typically a coenzyme $B_{12}$-dependent dehydratase) converts glycerol to an intermediate, 3-hydroxypropionaldehyde (3-HP). Then, 3-HP is reduced to 1,3-propanediol by an NADH- (or NADPH) dependent oxidoreductase. The 1,3-propanediol is not metabolized further; and, as a result, accumulates in high concentration in the media. See, for example, Zeng et al. (*Adv.*

*Biochem. Eng. Biotechnol.*, 74:239-259 (2002)); U.S. Pat. No. 5,686,276; WO 01/012833; U.S. No. 60/37493; U.S. No. 60/416,192; and U.S. No. 60/433,708. Each patent application is incorporated by reference in the instant specification as though set forth in their entirety herein.

The enzymes responsible for converting glycerol to 3-HP are largely coenzyme $B_{12}$-dependent glycerol dehydratases (E.C. 4.2.1.30) and coenzyme $B_{12}$-dependent diol dehydratases (E.C. 4.2.1.28). Genes encoding these enzymes have been identified in *Klebsiella pneumoniae, K. oxytoca, Citrobacter freundii, Clostridium pasteurianum, Salmonella typhimurium,* and *Lactobacillus collinoides* (Toraya, T., In *Metalloenzymes Involving Amino Acid-Residue and Related Radicals*; Sigel, H. and Sigel, A., Eds.; Metal Ions in Biological Systems; Marcel Dekker: New York, 1994; Vol. 30, pp 217-254; Daniel et al., *FEMS Microbiol. Rev.* 22:553-566 (1999); and Sauvageot et al., *FEMS Microbiol. Lett.* 209: 69-74 (2002)).

Structurally, the coenzyme $B_{12}$-dependent dehydratase is composed of three subunits: the large or "α" subunit, the medium or "β" subunit, and the small or "γ" subunit. These subunits assemble in an $\alpha_2\beta_2\gamma_2$ structure to form the apoenzyme. Coenzyme $B_{12}$ (the active cofactor species) binds to the apoenzyme to form the catalytically active holoenzyme. Coenzyme $B_{12}$ is required for catalytic activity, as it is involved in the radical mechanism by which catalysis occurs.

Biochemically, coenzyme $B_{12}$-dependent dehydratases are known to be subject to mechanism-based suicide inactivation by glycerol and other substrates (Daniel et al., supra; Seifert, et al., *Eur. J. Biochem.* 268:2369-2378 (2001)). In addition, inactivation occurs via interaction of the holoenzyme with high concentrations of 1,3-propanediol. Inactivation involves cleavage of the cobalt-carbon (Co—C) bond of the coenzyme $B_{12}$ cofactor, leading to the formation of 5'-deoxyadenosine and an inactive cobalamin species. This inactivation can significantly decrease the reaction kinetics associated with 3-HP formation and, thus, indirectly decrease 1,3-propanediol production.

Although the effects of coenzyme $B_{12}$-dependent dehydratase inactivation can be partially overcome in a variety of ways, a preferred method would be the identification of a coenzyme $B_{12}$-dependent dehydratase with reduced inactivation kinetics. This would increase the turnover ratio (mol product/mol holoenzyme) of coenzyme $B_{12}$-dependent dehydratase in a microbial host, thereby reducing the dehydratase and coenzyme $B_{12}$ demand.

Standard Methods of Genetically Engineering GDH

Several mutant GDH genes were developed (U.S. Provisional Application No. 60/433,708 and the disclosure herein) that possess reduced inactivation kinetics, using: 1.) error-prone PCR to generate mutant libraries targeting either the α-, β-, and γ-subunit of GDH, or the α- and a portion of the β-subunit of GDH; and 2.) oligo-directed mutagenesis, targeting amino acids No. 141-152, No. 219-226, and No. 330-342 of the α-subunit of GDH.

One of these mutants, containing 5 total mutations (one of which was a fusion of the α- and β-subunits), was investigated in further detail by: 1.) constructing two mutants containing only the fusion mutation, with respect to the wildtype GDH; and 2.) creating a point mutation to return one codon to its wildtype sequence, leaving 4 mutations.

Each of these genes are summarized below in Table 4, according to their specific mutations, T2/T1 ratio (which provides an indication of enzyme stability during a 40 minute reaction that occurs in the presence of 50 mM 1,3-propanediol and 12 mM glycerol) and T2 value. T2 is an estimation of the enzyme's total turnover number (i.e., $k_{cat}/k_{inact\ obsd}$), while T1 is directly proportional to $k_{cat}$.

TABLE 4

Summary of Error-Prone PCR Mutants, Olgio-Directed Mutagenesis Mutants, and Point-Mutants Having Improved Reaction Kinetics

| Strain | Mutations | T2/T1 ratio* | T2* |
|---|---|---|---|
| Wild-type GDH (SEQ ID NO: 67) | None | 1.00 | 1.00 |
| Xba3007 | ACC(γ-Thr53) to GCC(Ala) | 4.30 | 0.78 |
| Xba3029 | CTC(α-Leu509) to TTC(Phe) | 3.24 | 0.91 |
| Xba3025 | ATC(γ-Ile49) to ACC(Thr) | 2.77 | 0.84 |
| Xba3015 | GTT(α-Val549) to GCT(Ala) CTG(β-Leu113) to CCG(Pro) GCC(γ-Ala122) to GTC(Val) GCG(γ-Ala128) to GTG(Val) | 2.36 | 1.13 |
| Xba3008 | TCT(β-Ser122) to CCC(Pro) AAA(β-Lys166) to AGA(Arg) | 2.12 | 1.15 |
| Xba3016 | ATC(α-Ile102) to ACC(Thr) | 1.72 | 1.18 |
| Xba3020 | CCG(β-Pro152) to ACG(Thr) | 1.65 | 1.04 |
| Xba3010 | CTG(α-Leu318) to TTG(Leu) AAC(α-Asn447) to AAT(Asn) AAT(α-Asn489) to AGT(Ser) GCC(β-Ala27) to TCC(Ser) | 1.25 | 1.39 |
| Xba3023 | CAC(α-His96) to CAT(His) ATC(α-Ile102) to GTC(Val) GGG(α-Gly63) to GGA(Gly) | 1.00 | 1.22 |
| Sma3002 | TAT(α-Tyr271) to TGT(Cys) TAC(α-Tyr502) to CAC(His) TAA(stop of α) to CAA(Gln) CAA(β-Gln2) to CGA(Arg) TTT(β-Phe11) to TTC(Phe) | 2.73 | 1.60 |
| Sma3003 | ATG(α-Met62) to CTG(Leu) | 1.95 | 1.16 |
| Sma3009 | ATG(α-Met62) to GTG(Val) ATC(α-Ile63) to GTC(Val) AAA(α-Lys149) to AGA(Arg) | 2.75 | 0.71 |
| Sma3010 | ATG(α-Met62) to GTG(Val) GCG(β-Ala53) to GTG(Val) | 2.03 | 0.96 |
| Sma3008 | ATG(α-Met62) to ACG(Thr) CTG(α-Leu268) to CTA(Leu) | 1.75 | 0.95 |
| PpuMI002 | CGG(α-Arg137) to AGG(Arg) GAT(α-Asp150) to CAT(His) | 2.43 | 0.57 |
| RsrII001 | TTC(α-Phe339) to GTC(Val) CGC(α-Arg346) to CGG(Arg) | 1.92 | 0.72 |
| 4BR1001 | GGC(α-Gly216) to GGG(Gly) GTG(α-Val224) to CTG(Leu) | 1.90 | 1.10 |
| KG005 | ACT(α-Asn288) to ACC(Asn) ATG(α-Met306) to TTG(Leu) CCG(β-Pro152) to TCG(Ser) | 1.62 | 1.33 |
| 8-C9 | TAC(α-Tyr502) to CAC(His) TAA(stop of α) to CAA(Gln) CAA(β-Gln2) to CGA(Arg) TTT(β-Phe11) to TTC(Phe) | 1.3 | 1.83 |
| 1-E1 | TAA(stop of α) to CAA(Gln) | 0.72 | 1.82 |

*The values for T2/T1 ratio and T2 are relative numbers normalized to the wildtype (SEQ ID NO: 67).

In addition to the mutants shown above in Table 4, site-saturation mutagnesis was performed on 3 codons within GDH that appeared to play an important role in enzyme functionality. Screening based on an assay designed to measure total enzyme turnover number in the presence of 600 mM 1,3-propanediol ($T_{(600)}$) allowed identification of 4 additional mutants that had reduced inactivation kinetics with respect to the wildtype GDH, as shown in Table 5.

TABLE 5

Summary of Saturation Mutants Having Improved Reaction Kinetics

| Strain | Mutations | $T_{(600)}$* |
|---|---|---|
| Wild-type GDH (SEQ ID NO: 67) | — | 1 |

TABLE 5-continued

Summary of Saturation Mutants Having Improved Reaction Kinetics

| Strain | Mutations | $T_{(600)}$* |
|---|---|---|
| GDH-SM1-G11 | TAA(stop of α) to CAA(Gln) | 4.3 |
| | ACC(γ-Thr53) to TCC(Ser) | |
| GDH-SM2-B11 | TAA(stop of α) to CAA(Gln) | 4.1 |
| | CTC(α-Leu509) to TTT(Phe) | |
| GDH-SM3-D2 | GTG(α-Val224) to TTG(Leu) | 4.0 |
| | TAC(α-Tyr502) to CAC(His) | |
| | TAA(stop of α) to CAA(Gln) | |
| | CAA(β-Gln2) to CGA(Arg) | |
| | TTT(β-Phe11) to TTC(Phe) | |
| GDH-SM4-H2 | TAA(stop of α) to CAA(Gln) | 4.1 |
| | ACC(γ-Thr53) to TGT(Cys) | |

*The T(600) values are relative numbers normalized to the wildtype (SEQ ID NO: 67).

Despite significant improvements towards overall reduction of the mutant GDHs' inactivation kinetics (Table 4 and Table 5) with respect to the wild-type enzyme, these mutant genes are used as template molecules in the present invention to further improve the inactivation kinetics of the enyzme for use in an industrial process for the production of 3-HP and 1,3-propanediol. As with the PAL/TAL work, the known mutations of these parental templates serve as "molecular markers" to further assess the capacity of the recombinogenic extension method using unpaired primers to generate recombinogenic products. Further, these templates allow assessment of the quality of the recombinogenic products generated using the unpaired primers method, with respect to those obtained via "standard" methods of mutagenesis well known to one of skill in the art.

The Recombinogenic Extension Method Using Unpaired Primers

Twenty-four mutant GDH genes possessing a total of 42 molecular markers were used as template molecules in the recombinogenic extension method with unpaired primers. A short flanking DNA fragment was attached to the 5' or 3' end of each parent gene, using standard PCR, to ensure that subsequent primers could be designed such that the forward primer anneals to the 5' region of the first 11 template molecules (but not to the 5' region of the second 13 template molecules), while the reverse primer anneals with the 3' region of the second 13 template molecules (but not to the 3' region of the first 11 template molecules). These short flanking DNA fragments each contained a unique restriction enzyme site that would enable complete elimination of any trace amounts of parent template contamination after the recombinogenic processes. Primer directed extension was then conducted in a replication composition using thermal cycling conditions which promoted denaturation and extremely abbreviated annealing/polymerase-catalyzed extension.

Following restriction enzyme digestion on the products of the recombinogenic extension method, to ensure that only recombinogenic products were cloned, approximately 7000 colonies containing the mutant GDHs were screened to identity those with reduced inactivation kinetics in the presence of high concentrations of 1,3-propanediol (by assaying T(600) as a measure of the total enzyme turnover number). Nine positive mutants were characterized, each having at least 139% improved T(600) values with respect to best mutant obtained via error-prone PCR. The best mutant was 660% improved over the wild-type GDH, as measured by its T(600) value. Sequencing of these mutants revealed that the recombinogenic extension method of the present invention incorporated up to four different mutations from four different parent template molecules into a single 2.7 kB recombinogenic product. Additionally, new mutations were also introduced into the recombinogenic products that were not found in the parent templates.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions.

General Methods

Procedures required for PCR amplification, DNA modifications by endo- and exonucleases (for generating desired ends for cloning of DNA and ligation), and bacterial transformation are well known in the art. Standard molecular cloning techniques are used herein and are described by Sambrook, J., Fritsch, E. F. and Maniatis, T. in *Molecular Cloning: A Laboratory Manual*, $2^{nd}$ ed. (Cold Spring Harbor Laboratory: Cold Spring Harbor, N.Y., 1989; hereinafter "Maniatis"); by Silhavy, T. J., Bennan, M. L. and Enquist, L. W. in *Experiments with Gene Fusions* (Cold Spring Harbor Laboratory: Cold Spring, N.Y., 1984); and by Ausubel et al. in *Current Protocols in Molecular Biology* (Greene Publishing and Wiley-Interscience; 1987).

Materials and methods suitable for the maintenance and growth of bacterial cultures are well known in the art. Techniques suitable for use in the following examples may be found as set out in: 1.) *Manual of Methods for General Bacteriology* (Phillipp Gerhardt, R. G. E. Murray, Ralph N. Costilow, Eugene W. Nester, Willis A. Wood, Noel R. Krieg and G. Briggs Phillips, Eds., American Society for Microbiology: Washington, D.C., 1994); or 2.) by Brock, T. D. in *Biotechnology: A Textbook of Industrial Microbiology*, 2nd ed. (Sinauer Associates: Sunderland, Mass., 1989). All reagents, restriction enzymes and materials used for the growth and maintenance of bacterial cells were obtained from Aldrich Chemicals (Milwaukee, Wis.), DIFCO Laboratories (Detroit, Mich.), GIBCO/BRL (Gaithersburg, Md.), Sigma Chemical Company (St. Louis, Mo.), or Promega (Madison, Wis.), unless otherwise specified.

PCR reactions were run on a PTC-200 DNA Engine (MJ Research, Waltham, Mass.) using the Expand High Fidelity PCR System (Roche Applied Science, Indianapolis, Ind.) or a GeneAMP PCR System 9700 using Amplitaq or Amplitaq Gold enzymes (PE Applied Biosystems, Foster City, Calif.), unless otherwise specified. The cycling conditions and reactions were standardized according to the manufacturer's instructions, unless stated otherwise.

DNA sequencing reactions were performed on an ABI 377 automated sequencer (PE Applied Biosystems), unless otherwise specified. Likewise, data was managed using the Vector NTI program (InforMax, Inc., Bethesda, Md.) or DNAstar program (DNASTAR Inc., Madison, Wis.).

The meaning of abbreviations is as follows: "sec" means second(s), "min" means minute(s), "hr" means hour(s), "d" means day(s), "μL" means microliter(s), "mL" means milliliter(s), "L" means liter(s), "mm" means millimeter(s), "μm" means micrometer(s), "nm" means nanometer(s), "mM" means millimolar, "μM" means micromolar, "nM" means nanomolar, "M" means molar, "mmol" means millimole(s), "μmol" mean micromole(s), "ng" means nanogram, "mg" means milligram(s), "g" means gram(s), "kB" means kilobase(s), "mU" means milliunit(s), and "U" means unit(s).

Strains, Vectors and Culture Conditions

Escherichia coli XL1-Blue MRF electroporation-competent cells were purchased from Stratagene (La Jolla, Calif.). Escherichia coli BL21 (DE3) cells were used for enzyme over-expression (Shuster, B. and Retey, J., FEBS Lett. 349: 252-254 (1994)). Wild-type Escherichia coli 5K was originally obtained from Coli Genetic Stock Center (CGSC #4510; Yale University, New Haven, Conn.) and lysogenized with lambda DE3 (5K(DE3)).

The unpaired primers recombinogenic products were cloned into pCR4TOPO (Invitrogen Carlsbad, Calif.). pET17b was purchased from Novagen (Madison, Wis.). Vector pBluescript 11 SK+ was purchased from Stratagene.

The construction of vector PCA12Km and construct EP18Km-6 has been described in U.S. Pat. No. 6,521,748. Emptage et al. (WO01/12833) describes the construction of plasmid pDT2, which comprises the Klebsiella pneumonia dhaB1, dhaB2, and dhaB3 genes. The plasmid pGD20 was constructed by inserting the HindIII/XbaI fragment of pDT2 (containing dhaB1, dhaB2, and dhaB3) into pBluescript II SK+, thereby placing expression of the GDH genes under the control of the T7 promoter.

All kits for molecular biological applications were used according to the manufacturers' instructions, unless otherwise specified.

Whole Cell TAL/PAL Activity Assay

The E. coli cells were grown in Luria-Bertoni (LB) medium overnight. The cell concentration was estimated by measuring $OD_{600nm}$, and then adjusted to an OD600 nm of 1. One mL of the adjusted cell culture was pelleted and resuspended in 1 mL of 50 mM Tris-HCl buffer (pH 8.5) containing 0.5 mM tyrosine (for TAL activity measurement) or 0.5 mM phenylalanine (for PAL activity measurement). The reaction mixture was incubated on a shaker at 37° C. for 1 hr. The TAL or PAL activity was determined by measuring the concentration of the resulting PHCA or cinnamate. This was accomplished by filtrating the reaction mixture using a 0.2 μm pore size filter (Millipore, Bedford, Mass.) and injecting the filtrate into a Hewlett Packard 1100 HPLC system (Hewlett-Packard Company, Palo Alto, Calif.) to determine the concentration of the PHCA or cinnamate.

PHCA HPLC Analysis

A Hewlett Packard 1100 HPLC system (Palo Alto, Calif.) with an auto sampler and a diode array UV/vis detector was used with a reverse-phase Zorbax SB-C8 column (4.6 mm×250 mm) supplied by Hewlett Packard Co. HPLC conditions were as follows: flow rate: 1.0 mL per min; column temperature: 40° C.; solvent program: shown in Table 6. The UV detector was set to monitor the eluant at 250, 230, 270, 290 and 310 nm wavelengths.

TABLE 6

Solvents/Gradients

| Time (min) | Solvent A Methanol | Solvent B 0.2% TFA |
|---|---|---|
| 0.0 | 10% | 90% |
| 0.1 | 10% | 90% |
| 9.0 | 35% | 65% |
| 9.1 | 50% | 50% |
| 14.0 | 50% | 50% |

TABLE 6-continued

Solvents/Gradients

| Time (min) | Solvent A Methanol | Solvent B 0.2% TFA |
|---|---|---|
| 18.0 | 0% | 0% |
| 21.0 | 0% | 0% |

Retention time (RT) of related metabolites using the HPLC system described above are summarized below, in Table 7.

TABLE 7

HPLC Retention Times of Related Metabolites

| Compounds (1.0 mM) | RT (min) |
|---|---|
| 1. tyrosine | 6.7 |
| 2. phenylalanine | 9.4 |
| 3. 4-hydroxybenzoic acid (PHBA) | 11.6 |
| 4. 3,4-dihydroxycinnamate (caffeic acid) | 12.5 |
| 5. 3-(4-hydroxyphenyl)propionate | 13.3 |
| 6. 4-hydroxyphenylpyruvate | 13.6 |
| 7. 4-hydroxyacetaphenone | 14.0 |
| 8. 4-hydroxycinnamic acid (PHCA) | 14.2 |
| 9. 2-hydroxycinnamic acid (OHCA) | 15.3 |
| 10. benzoic acid | 15.5 |
| 11. coumarin | 16.0 |
| 12. cinnamyl alcohol | 17.3 |
| 13. phenylpyruvate | 18.1 |
| 14. cinnamic acid | 18.3 |

High Throughput PAL/TAL Screening Assay

Direct measurement of the TAL/PAL ratio using whole cells in high throughput fashion permitted screening of mutants with improved TAL or PAL activity (described in detail in U.S. Pat. No. 6,521,748). Several thousand of clones per day can be screened when colonies are manually picked.

E. coli colonies were picked from agarose plates and grown in 96-deep-well plates (Beckman Coulter, Inc., Fullerton, Calif.) containing 0.3 mL of growth culture. Each plate was covered and grown on a shaker at 300 rpm at 36° C. for 5-16 hrs. After growth, 25 μL of cell culture was transferred to a Millipore MultiScreen 96-well plate (Millipore, Bedford, Mass.), the bottom of which has a 0.22 μm pore size Durapore membrane that prevents passage of E. coli cells but allows removal of the growth medium by vacuum. The cells were then washed with 50 mM Tris-HCl (pH 8.5) using a Biomek2000 Laboratory Automation Workstation (Beckman Coulter, Inc.).

To measure the TAL activity, 100 μL of 0.5 mM tyrosine was added to each well and incubated on a shaker at room temperature for 5-12 hrs. Then, the reaction solution was separated from the cells and transferred into a Coster 96-well UV plate (Corning, Corning, N.Y.) by applying vacuum using Biomek2000. A similar procedure was used to measure PAL activity, except 0.5 mM phenylalanine was used for the reaction. For detection, absorption was measured at 290 or 270 nm using a SpectraMAX190 96-well plate reader (Molecular Devices Corp., Sunnyvale, Calif.) to examine the formation of PHCA or cinnamate.

The TAL/PAL ratio was calculated after exporting TAL and PAL data to Microsoft® (Redmond, Wash.) Excel, in order to eliminate variability due to differences in cell growth rate and enzyme expression level.

GDH High Throughput Screening Assays

Cultures expressing either wild-type $B_{12}$-dependent dehydratase or mutant $B_{12}$-dependent dehydratase libraries produce apo-$B_{12}$-dependent dehydratase if they have no source of the enzyme's cofactor, coenzyme $B_{12}$. In contrast, holoenzyme forms spontaneously if coenzyme is added to toluene- and detergent-permeabilized whole cells. It is therefore possible to "start" a $B_{12}$-dependent dehydratase reaction by adding coenzyme, plus substrate, to such cells. The reaction product, 3-HP, can be detected by a calorimetric aldehyde assay (Zurek, G., Karst, U. *Analytica Chimica Acta*, 351:247-257 (1997)) using the reagent 3-methyl-2-benzothiazolinone (MBTH) and an oxidant, ferric chloride. High throughput GDH assays are discussed in U.S. Provisional Application No. 60/433,708 herein incorporated by reference.

Two-Point High Throughput GDH Screening Assay

Colonies from plated libraries were picked into 94 wells in a standard 96-well micro-titer plate containing 0.15 mL/well of 15% Lennox broth (made by diluting 15 volumes of Lennox broth (Gibco-BRL, Rockville, Md.) with 85 volumes of 0.5% NaCl, followed by sterilization). The remaining two wells were inoculated with cells producing wild-type GDH, and the cells were allowed to grow at 37° C. in a static incubator for 4-6 hr. Alternatively, if storage of the picked cells at –80° C. before screening was desired, the medium also included glycerol (10% v/v), and the picked cells were allowed to grow overnight before being stored. Before screening, previously frozen cells were transferred with a 96-pin inoculator (V&P Scientific, San Diego, Calif.) into fresh 96-well plates containing 15% Lennox broth without glycerol and allowed to grow for 6-16 hr at 37° C. without shaking.

The cell growth protocol was as follows: 15% Lennox broth medium was dispensed (0.3 mL/well) into the wells of polypropylene deep-well 96-well plates (Beckman-Coulter, Fullerton, Calif.). Cells were inoculated from the shallow 96-well plates into the deep wells using a 96-pin long-pin inoculator (V&P Scientific), and the plate was covered with 3" wide Micropore surgical tape (3M Health Care, St. Paul, Minn.). The shallow 96-well plates were stored at 4° C. until the assays' completion, when they were used as a source of viable cells for further examination of lines identified as potentially improved. The cells in the deep-well plates were allowed to grow with shaking (250 rpm) at 37° C. overnight. The air in the incubator (Innova 4300, New Brunswick Scientific, New Brunswick, N.J.) was humidified with a wet sponge in a plastic tray.

Cells were permeabilized in the 96-well plates by adding 10 μL of toluene containing 2.5% (v/v) Triton X-100 detergent to each well. Plates were then shaken for 10 min at top speed on an IKA MTS4 shaker (IKA-Werke Gmbh., Staufen, Germany). Aliquots (8 μL) of permeabilized cells were transferred into 96-well reaction plates using a Biomek 2000 robot (Beckman-Coulter), located in a Plexiglas® (Rohm and Haas, Philadelphia, Pa.) enclosure covered in red plastic film to protect the substrate mixture from white room light. Reaction at room temperature was initiated by robotic addition to the cells of 40 μL of substrate mixture (prepared under red light, and stored at –20° C. in foil-wrapped containers until needed) containing 24 μM coenzyme $B_{12}$, 12 mM glycerol, and 50 mM 1,3-propanediol in 0.1 M potassium-HEPES buffer, pH 8. Thirty seconds after substrate addition, a 12.5 μL aliquot of the reaction (the T1 sample) was transferred into a second plate whose wells contained 12.5 μL of 3-methyl-2-benzothiazolinone (MBTH) in 0.4 M glycine-HCl, pH 2.7. Approximately 40 minutes after substrate addition, a similar aliquot of the reaction (the T2 sample) was transferred to a third plate containing MBTH. At least 20 min after this transfer, 125 μL of a solution of 5.5 mM $FeCl_3$ in 10 mM HCl was added to each well of the second and third (MBTH-containing) plates. After a further 20-60 min, the blue color associated with GDH activity was quantitated as absorbance at 670 nm (Spectramax 160 plate reader, Molecular Devices, Sunnyvale, Calif.).

Data from the plate reader were transferred to a modified Microsoft® (Redmond, Wash.) Excel computer program. The program was formated to match the first (T1) and second (T2) samples from each reaction plate and to prepare output as tables of results showing plate, location within plate, and T1, T2, and T2/T1 ratio for each reaction. Those samples showing exceptionally high values for T1, T2, or T2/T1 ratio were streaked out from the retained shallow 96-well plates for further examination.

One-Point High Throughput GDH Screening Assay

When 1,3-propanediol concentration is higher than about 300 mM, the inactivation of GDH occurs almost immediately after the reaction is initiated. Thus, under these conditions, one cannot use the two-point high throughput screening assay described above to screen mutants because T1 cannot be accurately measured. In order to screen for mutants having improved total enzyme turnover number in the presence of high concentrations of 1,3-propanediol, the below modified high throughput screening assay was developed. In the late phase of fermentation for 1,3-propanediol bioproduction, the 1,3-propanediol concentration can reach up to 1 M.

Briefly, mutant cells were grown and permeabilized in 96-well plates, as described above. Aliquots (8 μL) of permeabilized cells were transferred into 96-well reaction plates using a Biomek 2000 robot. Reaction at room temperature was initiated by addition to the cells of 40 μL of substrate containing 24 μM coenzyme $B_{12}$, 12 mM glycerol, and 720 mM 1,3-propanediol in 0.1 M potassium-HEPES buffer, pH 8, using Qfill2 (Genetix, New Milton, Hampshire, UK) [final concentration of glycerol in the assay is 10 mM; final concentration of 1,3-propanediol in the assay is 600 mM]. After incubating the plate at room temperature for approximately 70 min, a 12.5 μL aliquot of the reaction was transferred into a second plate whose wells contained 12.5 μL of MBTH in 0.4 M glycine-HCl, pH 2.7, using a Biomek 2000 robot. The concentration of the product, 3-HP, was determined as described above for the two-point assay. The total enzyme turnover number (T(600)) was estimated by measuring the absorbance at 670 nm using a Spectramax 160 plate reader.

Comparative results of assays performed using the two-point and one-point assay for wild-type GDH and for several mutants having different enzyme kinetic parameters are shown below in Table 8.

TABLE 8

Comparison of T2/T1 and T(600) Values, Obtained Using the Two-Point and One-Point High Throughput GDH Assays

| Sample | T1* | T2* | T2/T1* | T(600)* |
|---|---|---|---|---|
| WT | 1 | 1 | 1 | 1 |
| 1 | 1.5 | 2.1 | 1.4 | 4.6 |
| 2 | 0.8 | 1.8 | 2.3 | 4.1 |
| 3 | 0.4 | 1.0 | 2.5 | 1.1 |
| 4 | 2.0 | 1.7 | 0.7 | 2.3 |

*The T(600), T1, T2 and T2/T1 values are relative numbers normalized to the wild-type.

Each assay screens for different kinetic parameters; however, those mutants identified with the one-point screening assay are more resistant to higher concentrations of 1,3-propanediol and generally have improved stability and reasonable values for $k_{cat}$.

Example 1

Generation of Recombinant PAL/TAL Genes Using the Recombinogenic Extension Method with Unpaired Primers Two PAL mutant genes, RM120-1 (SEQ ID NO:5) and RM492-1 (SEQ ID NO:9) were used to make a recombinant DNA library using the recombinogenic extension method of the present invention, based on unpaired primers. Both of these genes are point mutants produced from the original wild-type yeast *R. glutinis* PAL gene (SEQ ID NO:1).

Since the RM120-1 and RM492-1 genes are point mutants derived from the wild-type yeast PAL, both genes possess identical 5' and 3' ends. Therefore, the unpaired primer reaction requires the attachment of a short DNA fragment to the 5' or 3' of each gene. These two PCR products are then used as templates for the recombinogenic extension method using unpaired primers, and the products of the reaction were cloned and sequenced for analysis.

Attaching a Short Flanking DNA Fragment to the 5' or 3' End of the Parent Genes

A short flanking DNA fragment was attached to the 5' or 3' end of the parent genes by PCR. The following forward and reverse primers were used for these PCR reactions: 2000YF1 (SEQ ID NO:25), 18-3' (SEQ ID NO:26), 18-5' (SEQ ID NO:27), and 2000YR19T7 (SEQ ID NO:28). Two tandard high fidelity PCR reactions were performed using the Expand High Fidelity PCR System (Roche Applied Science, Indianapolis, Ind.), as described in the General Methods. Forward primer 2000YF1 and reverse primer 18-3' were used to amplify the RM120-1 gene and attach a flanking region at its 5' end. Forward primer 18-5' and reverse primer 2000YR19T7T were used to amplify the RM492-1 gene and attach a flanking region at its 3' end. The PCR reaction mixtures were then loaded onto a 1% agarose gel and the PCR products (approximately 2.2 kB) were purified from the gel using a QIAEXII DNA extraction kit (Qiagen, Valencia, Calif.).

Making Recombinogenic Mutant Products Using the Unpaired Primers Method

The two amplified PCR products were used as the templates for the generation of recombinant DNA products. Additionally, the following two unpaired primers were used: PADH316F1 (SEQ ID NO:29) and T7T (SEQ ID NO:30). Primer PADH316F1 anneals with the 5' end of the RM120-1 template, due to the addition the short DNA fragment produced by primer 2000YF1 (as described above). However, primer PADH316F1 does not bind to the 5' end of the RM492-1 template. In like manner, primer T7T anneals to the 3' end of the RM492-1 template, but does not bind to the 3' end of the RM120-1 template.

The following reaction mixture was assembled for the reaction: 10 ng RM120-1 template, 10 ng RM492-1 template, 200 µM each dNTP, 1×PCR Buffer (with 1.5 mM $MgCl_2$, as the final concentration), 300 nM pADH316F1, 300 nM T7T, 0.9 U Expand High Fidelity PCR System (Roche Applied Science, Indianapolis, Ind.), and $dH_2O$ to 25 µl. Thermal cycling conditions were: 94° C. denaturation for 10 min; followed by 99 cycles of 30 sec at 94° C., 5 sec at 50° C., 5 sec+1 sec per cycle at a gradient between 55-70° C.; 72° C. final extension for 7 min; and hold at 4° C.

Since the two primers used in the reaction do not match the 5' and 3' ends of either template simultaneously, neither of the parent templates can be amplified during the reaction. However, any recombinant DNA product possessing both the 5' and 3' ends would be amplified during subsequent thermal cycles. Following the unpaired primer reaction, the reaction mixtures were loaded onto a 1% agarose gel. FIG. 2 shows the results of the unpaired primer reaction. From left to right, the synthesis temperature was from 50° C. to 70° C. [the PTC-200 DNA Engine (MJ Research, Waltham, Mass.) offers a special feature which allows one to set a linear temperature gradient across the heating block]. At about 66° C., a large amount of 2.2 kB PCR products were obtained from the unpaired primer reaction. Products of this size were expected since the original parent molecules used as templates were themselves about 2.2 kB.

Making and Screening the Recombinogenic Mutant Library

The recombinogenic DNA products were purified from the gel using a DNA extraction kit (Qiagen, Valencia, Calif.) and then ligated into pCR4TOPO plasmid vector (Invitrogen Carlsbad, Calif.). The ligation mixture was then transformed by electroporation into XL1-Blue *E. coli* cells (Stratagene, La Jolla, Calif.).

Seven clones were randomly chosen for analysis and the plasmid DNA from each was purified using a plasmid Miniprep kit (Qiagen). The 5' and 3' end of the cloned inserts were sequenced on an ABI377 automated sequencer (Applied Biosystems, Foster City, Calif.), and the data managed using the Vector NTI program (InforMax, Inc., Bethesda, Md.). FIG. 3 shows the sequencing results, whereby all 7 clones were determined to be recombinogenic DNA products. Sequences shown in bold text have identity to the 5' end of the parent template RM120-1. Sequences underlined have identity to the 3' end of the parent template RM492-1. This result demonstrated that this novel technology using unpaired primers was an efficient method to create recombinogenic DNA products. The contamination of the parent templates in the library made by this approach was undetectable.

Example 2

Synthesis of "Molecular Marker" PAL/TAL Genes to Track Genetic Recombination Using Error-Prone PCR In order to further study the recombinogenic extension method using unpaired primers, it was necessary to generate several additional genes that could be used as "molecular markers" in order to track genetic recombination. Two mutant PAL genes known as WM-6 and WM-7 are created in this Example, using an error-prone PCR approach, which have altered enzyme activity and substrate specificity.

Error-Prone PCR

In order to generate mutants having significantly altered activity and/or substrate specificity, the mutant PAL gene EP18Km-6 (SEQ ID NO:3) was used as the starting gene for further mutagenesis. Primers 18-5' (SEQ ID NO:27) and 18-3' (SEQ ID NO:26) were used to amplify the entire mutant PAL gene from the EP18Km-6 construct (U.S. Pat. No. 6,521, 748) by error-prone PCR. Forward primer 18-5' primer contained a Xba I restriction enzyme site just before the ATG codon, while primer 18-3' had a Pst I site just after the stop codon.

Three strategies were applied to increase the rate of the PCR error: 1.) Standard Taq polymerase was used; 2.) Additional reaction cycles (i.e., 35 cycles) were used; and 3.) The ratio of dATP, dTTP, dGTP and dCTP was altered. Four different reactions were performed, such that the concentration of one of the dNTP's was 0.1 mM while the concentration of the other three dNTPs were adjusted to 0.4 mM.

Making the Mutant Library

PCR products from each of the four error-prone reactions were mixed together following completion of the reaction. After digestion of the error-prone PCR products with Xba I and Pst I, fragments were ligated into the XbaI-PstI-digested PCA12Km. A mutant library was obtained by transformation of the ligation mixture into E. coli strain XL1-Blue.

Screening the Mutant Library and Characterizing the Mutants 5,000 mutant colonies were picked from agarose plates and screened using the high throughput PAL/TAL screening assay, as described in the General Methods. The initial hits were further investigated by a follow-up assay to confirm screening results. The TAL and PAL activities were measured using the whole cell assay (see General Methods). The following Table (Table 9) summarizes results of the follow-up assay for two mutants of interest, in comparison to the EP18Km-6 gene used to initiate the error-prone PCR reaction.

TABLE 9

TAL and PAL activities and TAL/PAL ratio of two mutants made by error-prone PCR

| Strain | TAL (rel. units)* | PAL (rel. units)* | TAL/PAL ratio |
|---|---|---|---|
| EP18Km-6 (starting gene) | 130 | 76 | 1.7 |
| WM-6 | 7.5 | 4.9 | 1.5 |
| WM-7 | 52.5 | 53.0 | 1.0 |

*Relative units are a measure of the amounts of 4-hydroxycinnamic acid (for TAL) or cinnamic acid (for PAL) produced by whole cell assay, and are measured by the HPLC techniques described in the General Methods.

Both mutants showed significantly altered enzyme activities. Mutant WM-7 showed a large change in the TAL/PAL ratio, indicating a significant change in the substrate specificity in this mutant.

Sequence Analysis of the Mutants

Plasmid DNA was purified from these mutants using a plasmid Miniprep kit (Qiagen, Valencia, Calif.). The mutant genes were sequenced on an ABI377 automated sequencer (Applied Biosystems), and the data was managed using the Vector NTI program (InforMax, Inc). Analysis of the mutants, followed by comparison with the original wild-type yeast R. glutinis PAL gene, indicated that the mutant genes contained the following single base substitution mutations (point mutations):

TABLE 10

DNA sequence analysis of WM-6 and WM-7

| Strain | Mutations |
|---|---|
| WM-6 (SEQ ID NO: 11) | TCG(Ser27) to CCG(Pro) |
| | GAC(Asp126) to GTC(Val) |
| | GTC(Val318) to GCC(Ala) |
| | GCC(Ala624) to ACC(Thr) |
| | CTG(Leu215) to CTC(Leu)* |
| | GAA(Glu264) to GAG(Glu) |
| | GCT(Ala286) to GCA(Ala) |
| | ATC(Ile540) to ACC(Thr) |

TABLE 10-continued

DNA sequence analysis of WM-6 and WM-7

| Strain | Mutations |
|---|---|
| WM-7 (SEQ ID NO: 13) | CAC(His409) to CGC(Arg) |
| | CTG(Leu215) to CTC(Leu) |
| | GAA(Glu264) to GAG(Glu) |
| | GCT(Ala286) to GCA(Ala) |
| | ATC(Ile540) to ACC(Thr) |

*The mutations indicated in bold letters were present in the original mutant PAL gene (EP18Km-6) used as template for the error prone PCR.

These point mutations were used as the molecular markers for the unpaired primer reactions described in Examples 4 and 5.

Example 3

Cloning of RM120-7 Mutant PAL/TAL Gene into Vector PCA12Km

Mutant RM120-7 was identified as a suitable template gene, based on its known molecular markers. However, this gene was made in vector pET17b (U.S. Pat. No. 6,521,748), while parent template molecules WM-6 and WM-7 (from Example 2) were made in a PCA12Km vector. To eliminate any bias in recombination or screening and analysis of recombinants produced by the unpaired primers method, the RM120-7 gene was subcloned into the PCA12Km vector. This permitted direct comparison of each genes' activity using the whole cell assay.

Primers 18-5' (SEQ ID NO:27) and 18-3' (SEQ ID NO:26) were used to amplify the entire RM120-7 mutant PAL gene (SEQ ID NO:7) by a standard high fidelity PCR method, using the Expand High Fidelity PCR System (Roche, Indianapolis, Ind.) as described in the General Methods. The 18-5' primer contained a Xba I restriction enzyme site just before the ATG codon and primer 18-3' primer had a Pst I site just after the stop codon. The PCR product was digested with Xba I and Pst I, and then ligated into the XbaI-PstI-digested PCA12Km. The ligation mixture was transformed into E. coli strain XL1-Blue by electroporation. Several colonies were picked for plasmid preparation. The entire insert was sequenced on an ABI377 automated sequencer (Applied Biosystems), and the data was managed using the Vector NTI program (InforMax, Inc). Sequencing results showed that no mutations were introduced during subcloning.

Example 4

Improving Enzyme Activity and TAL/PAL Ratio of PAL Mutants Using the Unpaired Primers Method For Recombination of Two Parent Genes As shown in Example 1, the recombinant efficiency for the library made by the unpaired primers method was 100% in 7 out of 7 clones examined. This efficiency is significantly greater than previously published methods. Thus, it was desirable to apply this method to improve the enzyme activity and substrate specificity of mutant PAL/TAL enzymes. Two mutant PAL/TAL genes, WM-6 (SEQ ID NO:11) and RM120-7 (SEQ ID NO:13), were used as template molecules.

Attaching a Short Flanking DNA Fragment to the 5' or 3' End of Parent Genes

First, a standard high fidelity PCR was used to amplify each parent gene to create the templates. Two pairs of primers were used: 18-5' (SEQ ID NO:27) and 2000YR19T7T (SEQ ID NO:28) for amplification of WM-6; and 18-3' (SEQ ID NO:26) and 2000YF1 (SEQ ID NO:25) for amplification of RM120-7. The resulting PCR products each contained a short DNA fragment added to the 5'- or 3'-end of the original genes. The attached DNA fragments were used as the binding sites for the recombinogenic extension method using unpaired primers. The amplified products were purified from an agarose gel (as described in Example 1) and then used as the parent templates for the unpaired primer reaction.

Making Recombinogenic Mutant Products Using the Unpaired Primers Method

Recombinogenic products (i.e., mutant genes) were made from the two parent templates using the two unpaired primers PADH316F1 (SEQ ID NO:29) and T7T (SEQ ID NO:30), as described in Example 1. PADH316F1 anneals with the 5' end of the WM-6 template, due to the addition of the short DNA fragment produced by primer 2000YR19T7T (as described above). However, primer PADH316F1 does not bind to the 5' end of the RM120-7 template. In like manner, primer T7T anneals to the 3' end of the RM120-7 template, but does not bind to the 3' end of the WM-6 template.

The following reaction mixture was assembled for the reaction: 10 ng WM-6 template, 10 ng RM120-7 template, 200 μM each dNTP, 1×PCR Buffer (with 1.5 mM $MgCl_2$, as the final concentration), 300 nM pADH316F1, 300 nM T7T, 0.9 U Expand Enzyme Mixture (Roche), and $dH_2O$ to 25 μl. A 2-step gradient thermal cycling profile was applied to test for the optimal extension temperature: 94° C. denaturation for 2 min; followed by 100 cycles of 30 sec at 94° C., 5 sec+1 sec per cycle at a gradient between 50-70° C.; 72° C. final extension for 7 min; and hold at 4° C. From the results, it was determined that a temperature of 66° C. produced the most abundant amplification. This temperature was then used in a 2-step thermal cycling profile as shown below: 94° C. denaturation for 2 min; followed by 100 cycles of 30 sec at 94° C., 5 sec+1 sec per cycle at 66° C.; 72° C. final extension for 7 min; and hold at 4° C.

FIG. 4 shows the results of the unpaired primer reaction. Lane A is a standard molecular weight marker; Lane B shows recombination of two parent genes (this Example); and Lane C shows recombination of three parent genes (to be discussed in Example 5). As expected, recombinogenic DNA fragments around 2.2 kB in size were obtained. The recombinogenic products were then purified from the gel using a Qiagen DNA extraction kit (Qiagen, Valencia, Calif.).

Making and Screening the Recombinogenic Mutant Library

The recombinant DNA fragments were digested with Spe I and Pst I and then ligated into the XbaI-PstI-digested PCA12Km. The mutant library was obtained by transformation of the ligation mixture into XL1-Blue E. coli cells by electroporation. The library size was over 1 million colonies per ligation reaction.

4,800 mutant colonies were picked from agarose plates and screened by the PAL/TAL high throughput screening assay, as described in the General Methods. The initial hits were further investigated by a follow-up assay to confirm screening results. The TAL and PAL activities were measured using the whole cell assay (see General Methods). The following Table summarizes results of the follow-up assay for the two parent molecules used as templates (WM-6 and RM120-7) and three interesting mutants (1A-1, 1A-2, and 1A-3).

TABLE 11

Characterization of Recombinogenic Mutants Obtained in the Two-Gene Recombination Experiment

| Strain | TAL (rel. units)* | PAL (rel. units)* | TAL/PAL ratio |
|---|---|---|---|
| WM-6 | 7.5 | 4.9 | 1.5 |
| RM120-7 | 7.3 | 10.4 | 0.7 |
| 1A-1 | 135.8 | 75.4 | 1.8 |
| 1A-2 | 103.6 | 64.8 | 1.6 |
| 1A-3 | 74.4 | 49.6 | 1.5 |

*Relative units are a measure of the amounts of 4-hydroxycinnamic acid (for TAL) or cinnamic acid (for PAL) produced by whole cell assay, and are measured by the HPLC techniques described in the General Methods.

The results clearly demonstrated that the enzyme activity of the starting parent genes was substantially improved by recombining the two parent genes using the recombinogenic extension method with unpaired primers. Compared with the parent enzymes, the TAL activity of mutant 1A-1 was improved approximately 18-fold and its PAL activity was improved 7- to 15-fold. Mutants 1A-2 and 1A-3 also showed improvements in enzyme activity.

In addition to the improvement in enzyme activity, the TAL/PAL ratio of mutant enzymes was also improved in comparison with the parent enzymes. The TAL/PAL ratio shows the enzyme substrate specificity. For instance, the TAL/PAL ratio of mutant 1A-1 was improved 2.6-fold as compared to the parent enzyme RM120-7 and showed a 20% improvement to the parent WM-6. Mutants 1A-2 and 1A-3 also demonstrated improved TAL/PAL ratios compared with RM120-7. The results proved that the substrate specificity of the parent enzymes could be changed using the recombinogenic extension method with unpaired primers.

Sequence Analysis of the Mutant Genes

Plasmid DNA from mutants 1A-1, 1A-2, and 1A-3 was purified and the entire gene sequence of each of these mutants was sequenced on an ABI377 automated sequencer (Applied Biosystems). Data management occurred using the Vector NTI program (InforMax, Inc). Analysis of the mutants, followed by comparison with the original wild-type yeast R. glutinis PAL gene, indicated that the mutant genes contained the following single base substitution mutations (point mutations):

TABLE 12

DNA sequence analysis of Mutants 1A-1, 1A-2 and 1A-3

| Strain | Mutations |
|---|---|
| 1A-1 (SEQ ID NO: 15) | TCG(Ser149) to CCG(Pro) |
| | CGC(Arg661) to CGT(Arg) |
| | CTG(Leu215) to CTC(Leu)* |
| | GAA(Glu264) to GAG(Glu) |
| | GCT(Ala286) to GCA(Ala) |
| | ATC(Ile540) to ACC(Thr) |
| 1A-2 (SEQ ID NO: 17) | TCG(Ser149) to CCG(Pro) |
| | GTC(Val318) to GCC(Ala) |
| | GCC(Ala624) to ACC(Thr) |
| | CTG(Leu215) to CTC(Leu)* |
| | GAA(Glu264) to GAG(Glu) |
| | GCT(Ala286) to GCA(Ala) |
| | ATC(Ile540) to ACC(Thr) |
| 1A-3 (SEQ ID NO: 19) | TCG(Ser149) to CCG(Pro) |
| | GTC(Val318) to GCC(Ala) |
| | GAG(Glu543) to GAA(Glu) |
| | GCC(Ala624) to ACC(Thr) |
| | ATG(Ile707) to GTC(Val) |
| | CTG(Leu215) to CTC(Leu)* |

TABLE 12-continued

DNA sequence analysis of Mutants 1A-1, 1A-2 and 1A-3

| Strain | Mutations |
|---|---|
| | GAA(Glu264) to GAG(Glu) |
| | GCT(Ala286) to GCA(Ala) |
| | ATC(Ile540) to ACC(Thr) |

*The mutations indicated in bold letters were present in the original mutant PAL gene (EP18Km-6).

FIG. 5 shows the comparison of the two parent genes and the three recombinogenic mutant genes. Mutations are illustrated by showing the wild-type nucleotide, the position and the mutant nucleotide (i.e., T445C signifies the wild-type nucleotide "T" at position 445 within the gene was mutated to a "C"). The amino acid substitution is shown in parentheses (i.e., S147P signifies the change at amino acid position 147 from a serine to a proline). Since both parent genes contained the four point mutations from the EP18Km-6 (labeled in bold letters in Table 12), these mutation were not shown in FIG. 5. The other mutations shown in FIG. 5 served as the molecular markers for the recombinogenic reaction (mutant sites identified by diagonal lines were native to parent RM120-7, while mutant sites in black were native to parent WM-6).

The results clearly demonstrated recombination of the parent templates. For example, 1A-2 and 1A-3 mutants each contained one mutation (T445C) from RM120-7 and two mutations (T953C and G1870A) from WM-6. The other three mutations present in the parent molecules (A604 from RM120-7; and T79C and A377T from WM-6) were removed in these two mutants by recombination. Mutant 1A-1 lost all mutations in the parent genes by recombination, with the exception of T445C from RM120-7. The recombination reactions also introduced new mutations into the mutant genes. These mutations were either silent (i.e., C1983T in mutant 1A-1 and G1629A in mutant 1A-3) or introduced conservative amino acid substitutions (i.e., A2119G in 1A-3). Additionally, mutant 1A-3 contained a new amino acid substitution at position 707, where isoleucine was exchanged for valine.

Example 5

Improving Enzyme Activity and TAL/PAL Ratio of PAL Mutants Using the Unpaired Primers Method for Recombination of Three Parent Genes Example 4 showed that the enzyme activity and substrate specificity could be improved using the recombinogenic extension method with unpaired primers, when using two genes as templates. The objective of this Example was to prove that the unpaired primer reaction could be used with a pool of template molecules to improve enzyme activity and substrate specificity. Thus, three-gene recombination was tested using WM-6 (SEQ ID NO:11), WM-7 (SEQ ID NO:13), and RM120-7 (SEQ ID NO:7) as the parent genes.

Attaching a Short Flanking DNA Fragment to the 5' or 3' End of Parent Genes

As shown in Example 4, a standard high fidelity PCR was used to amplify each parent gene to create the templates. Two pairs of primers (as described in Example 1) were used: 18-5' (SEQ ID NO:27) and 2000YR19T7T (SEQ ID NO:28) for amplification of WM-6 and WM-7; and 18-3' (SEQ ID NO:26) and 2000YF1 (SEQ ID NO:25) for amplification of RM120-1. The resulting PCR products each contained a short DNA fragment added to the 5'- or 3'-end of the original genes. The attached DNA fragments were used as the binding sites for the unpaired primer reaction. The amplified products were purified from an agarose gel as described in Example 1, and then used as the parent templates for the recombinogenic extension method with unpaired primers.

Making Recombinogenic Mutant Products Using the Unpaired Primers Method

Recombinogenic products (i.e., mutant genes) were made from three parent templates using the two primers PADH316F1 (SEQ ID NO:29) and T7T (SEQ ID NO:30), as described in Example 1. PADH316F1 anneals with the 5' end of the WM-6 and WM-7 templates, due to the addition of the short DNA fragment produced by primer 2000YR19T7T (as described above). However, primer PADH316F1 does not bind to the 5' end of the RM120-7 template. In like manner, primer T7T anneals to the 3' end of the RM120-7 template, but does not bind to the 3' end of the WM-6 or WM-7 templates. The following reaction mixture was assembled for the reaction: 5 ng WM-6 template, 5 ng WM-7 template, 10 ng RM120-7 template, 200 µM each dNTP, 1×PCR Buffer (with 1.5 mM MgCl$_2$, as the final concentration), 300 nM pADH316F1, 300 nM T7T, 0.9 U Expand Enzyme Mixture (Roche), and dH$_2$O to 25 µl.

The unpaired primer reaction was performed as described in Example 4. FIG. 4, lane C shows the results of the unpaired primer reaction. The recombinant DNA products (around 2.2 kB) were then purified from the gel using a Qiagen DNA extraction kit.

Making and Screening the Recombinogenic Mutant Library

The Spe I-Pst I-digested recombinant DNA fragments were ligated into the XbaI-PstI-digested PCA12Km, as described in Example 4. The mutant library was obtained by electroporating the ligation mixture into XL1-Blue E. coli cells. 4,800 mutant colonies were screened as described in Example 4. The initial hits were further investigated by follow-up assays to confirm screening results. The TAL and PAL activities were measured using the whole cell assay. Table 13 summarizes results of the follow-up assay for two interesting mutants.

TABLE 13

Characterization of Recombinogenic Mutants Obtained in the Three-Gene Recombination Experiment

| Strain | TAL (rel. units)* | PAL (rel. units)* | TAL/PAL ratio |
|---|---|---|---|
| WM-6 | 7.5 | 4.9 | 1.5 |
| WM-7 | 52.5 | 53.0 | 1.0 |
| RM120-7 | 7.3 | 10.4 | 0.7 |
| 3A-1 | 131.3 | 76.0 | 1.7 |
| 3A-2 | 105.0 | 52.0 | 2.0 |

*Relative units are a measure of the amounts of 4-hydroxycinnamic acid (for TAL) or cinnamic acid (for PAL) produced by whole cell assay, and are measured by the HPLC techniques described in the General Methods.

Similar to the results of the two-gene recombination experiment described in Example 4, the above results showed improved enzyme activity and substrate specificity compared to the parent enzymes, by recombination of the three parent genes using the recombinogenic extension method with unpaired primers. Mutant 3A-1 showed increased enzyme activity when compared to all three parent enzymes. Mutant 3A-2 had a higher TAL/PAL ratio than any of the parent enzymes, indicating a change in the substrate specificity.

Sequence Analysis of the Mutant Genes

The plasmid DNA was purified from mutants 3A-1 and 3A-2 and each recombinogenic gene was sequenced. Analysis of the mutants, followed by comparison to the original wild-type yeast *R. glutinis* PAL gene, indicated that the mutant genes contained the following single base substitution mutations (point mutations):

TABLE 14

DNA sequence analysis of Mutants 3A-1 and 1A-2

| Strain | Mutations |
| --- | --- |
| 3A-1 (SEQ ID NO: 21) | GTC(Val203) to GTT(Val) |
| | GCC(Ala624) to ACC(Thr) |
| | CTG(Leu215) to CTC(Leu)* |
| | GAA(Glu264) to GAG(Glu) |
| | GCT(Ala286) to GCA(Ala) |
| | ATC(Ile540) to ACC(Thr) |
| 3A-2 (SEQ ID NO: 23) | AAG(Lys352) to AGG(Arg) |
| | CTG(Leu215) to CTC(Leu) |
| | GAA(Glu264) to GAG(Glu) |
| | GCT(Ala286) to GCA(Ala) |
| | ATC(Ile540) to ACC(Thr) |

*The mutations indicated in bold letters were present in the original mutant PAL gene (EP18Km-6).

FIG. 6 shows the comparison of the three parent genes and the two recombinant mutant genes. Again, mutations are illustrated by showing the wild-type nucleotide, the position and the mutant nucleotide, with the amino acid substitution shown in parentheses. Since all three parent genes and both mutant genes contained the four point mutations from EP18Km-6 (labeled in bold letters on Table 14), these mutations were not shown in the Figure.

Similar to results obtained in the two-gene recombination experiment, FIG. 6 demonstrates the successful recombination of the three parent templates. Mutant 3A-1 retained the G1870A mutation from WM-6, but all other mutations in the parent genes were removed by recombination. The recombination reactions also introduced a new silent mutation into 3A-1 (C690T). Interestingly, all of the mutations in the parent genes were removed in mutant 3A-2; however, this mutant had a new mutation A1055G introduced by the recombinogenic extension reaction. This single base substitution changed the leucine to arginine at amino acid position 352.

Example 6

The Recombinogenic Extension Method Using Unpaired Primers with Flanking DNA Fragments Containing Different and Unique Restriction Sites The unpaired primer reaction only amplifies recombinogenic products (and not the parent templates). If the parent template contains the same restriction sites used for cloning as the recombinant mutant genes, however, the mutant library could be contaminated with trace amounts of the parental templates. For instance, in Example 5 Spe I and Pst I were used to digest the recombinant mutant genes. The WM-6 template contains Xba I and Pst I sites at its flanking regions, and the RM120-7 template contains Spe I and Pst I sites. These restriction sites were from the primers used for generating the templates. Obviously, WM-6 template cannot cause any contamination problems because it does not contain a Spe I site. But the RM120-7 template could be present as a contaminate in the mutant library. To completely reduce the contamination of the parent templates to zero, the following experiment engineers different primers to generate the RM120-7 template. As the result, the new RM120-7 template does not contain a Pst I site at its flanking region.

Attaching a Short Flanking DNA Fragment to the 5' or 3' End of Parent Genes

A standard high fidelity PCR was used to amplify the WM-6 and RM120-7 genes to create templates, as described in Example 4. However, the following new primer set was used for generating the RM120-7 template: 2000YF1 (SEQ ID NO:25) and 18-3' AC (SEQ ID NO:31). Originally, 18-3' primer (SEQ ID NO:26) contained a Pst I site (CTGCAG). In 18-3'AC (SEQ ID NO:31), the Pst I site has been removed by changing CTGCAG to CTGCCG.

The templates were purified from the agarose gel as described in Example 1, and then used as the parent templates for the unpaired primer reaction.

Making Recombinogenic Mutant Products Using the Unpaired Primers Method

The recombinant mutant genes were made by the recombinogenic extension method using unpaired primers, as described in Example 4. The following 2-step gradient thermal cycling profile was used: 94° C. denaturation for 2 min; followed by 100 cycles of 30 sec at 94° C., 5 sec+1 sec per cycle at a gradient of 63-70° C.; 72° C. final extension for 7 min; and hold at 4° C.

Gel analysis of the recombinogenic products showed that the unpaired primer reaction using the new templates with different restriction sites worked as well as the original templates used in Example 4. The recombinant mutant genes can be purified from the gel, digested with Spe I and Pst I, then cloned into the Xba I-Pst I-digested vector, as described in Example 4. Since the new RM120-7 template does not contain a Pst I site anymore, the contamination of parent templates in the mutant library will be practically zero.

Example 7

Random Mutagenesis of GDH

Two random mutant libraries were created using error-prone PCR amplification. The first targeted the dhaB1, dhaB2, and dhaB3 genes of *Klebsiella pneumonia* GDH; the second targeted primarily the *K. pneumonia* dhaB1 gene. Representative sequence analysis of the libraries demonstrated that there were approximately 4.2 and 4.5 point mutations per kB, respectively; enzyme activity measurements determined that about 15-25% of the mutants in each library were active.

Construction of the "Xba-library":. Random Mutagenesis Targeting the α-, β- and γ-Subunits of GDH A randomly generated mutant library targeting all three genes of GDH was created. First, the sequence comprising dhaB1 (1668 bp), dhaB2 (585 bp) and dhaB3 (426 bp) was amplified from pGD20 by error-prone PCR using the following primers: DHA-F1 (SEQ ID NO:36) and DHA-R1 (SEQ ID NO:37). A Clontech mutagenesis kit (Clontech Laboratories, Inc., Palo Alto, Calif.) was used for performing error-prone PCR. The reaction mixture consisted of the following: 38 µl PCR grade water, 5 µl 10× AdvanTaq Plus Buffer, 2 µl $MnSO_4$ (8 mM), 1 µl dGTP (2 mM), 1 µl 50× Diversify dNTP Mix, 1 µl Primer mix, 1 µl template DNA, and 1 µl AdvanTaq Plus Polymerase. The thermal cycling reaction was carried out according to the manufacturers' instructions. The 2.7 kB PCR products were digested with Hind III/Xba I, and prepared for ligation.

Although the entire insert containing all three genes of GDH can be removed from the pGD20 construct using a Hind III and Xba I digestion, the insert size is approximately 2.7 kB, while the vector size is about 2.9 kB. To facilitate separation of these two fragments on an agarose gel, pGD20 was digested using Hind III, Xba I and Pst I. Pst I does not cut the vector, instead only cutting the insert in three places to yield four small fragments from the insert. Thus, the digested vector migrated around 2.9 kB on the agarose gel without contamination from other DNA fragments. The Hind III/Xba I/Pst I-digested vector was then ligated with Hind III/Xba I-digested error-prone PCR products. After ethanol precipitation, the ligation mixture was ready for transformation.

Construction of the "Sma-library": Random Mutagenesis Targetinq the (α-Subunit and a Portion of the βSubunit of GDH The following primers were used to amplify, by error-prone PCR using pGD20 as template, the entire dhaB1 gene and an approximately 200 bp portion of the dhaB2 gene: DHA-F1 (SEQ ID NO:36) and DHA-R2 (SEQ ID NO:38). Error-prone PCR reactions were performed using a Clontech mutagenesis kit, as described above. The 1.9 kB PCR products were then digested with Hind III and Sma I.

To prepare the vector, the pGD20 plasmid was digested with Hind III and Sma I (to remove the wild-type dhaB1 gene and a portion of the dhaB2 gene) and then purified from an agarose gel. The Hind III/Sma I-digested error-prone PCR products were ligated with the Hind III/Sma I-digested pGD20 vector.

Transformation of Ligation Mixtures

Since the T7 promoter was used for the mutant library, an *E. coli* cell lysogenized with lambda DE3 was utilized as the host cell for mutant enzyme expression. Specifically, a 5K(DE3) *E. coli* strain was used for mutant library construction. First, electroporation-competent 5K(DE3) cells were made as follows: 2.5 mL of overnight cell culture was added to 500 mL of LB broth in a 2 L sterile flask. The culture was incubated at 37° C. on a shaker until the $OD_{600}$ reached 0.5 to 0.8. The cells were then incubated on ice for 10 min, followed by centrifugation at 4° C. for 10 min. After washing the cells once with 500 mL ice-cold water, the cells were resuspended in 1-2 mL of 10% ice-cold glycerol. Aliquots (50 µL) were made in sterile eppendorf tubes, and immediately frozen in dry ice. The competent cells were stored at −80° C.

For transformation, 1 µL of ligation mixture was added to 40 µL of competent cells, and the sample was transferred into an electroporation cuvette with a 0.1 cm gap. A voltage of 1.7 kv/cm was used for electroporation. The cells were plated onto LB plates in the presence of ampicillin and incubated overnight at 37° C.

DNA Sequence Analysis of the "Xba" and "Sma" Mutant Library

Nine (9) or ten (10) mutant colonies were randomly picked for DNA sequencing analysis, to examine the integrity of each library. For each mutant, the number of mutations produced, the location of mutations, and the particular types of mutations observed were determined. The analysis revealed that all types of base substitutions were present in the mutants, indicating lack of bias for a particular mutation type. In addition, only one deletion mutation was observed in the 19 mutant clones analyzed; no base insertion mutations were identified. This indicated that the frequency of deletion and insertion in the mutant libraries was very low. The average mutation rate was 4.2 point mutations per kB in the Xba-library and 4.5 point mutations per kB in the Sma-library.

Enzyme activity measurements revealed that approximately 15-25% of the mutants in both libraries were active.

Example 8

Regional Random Mutagenesis of the α-Subunit of GDH

Based on the crystal structure of GDH (Liao et al., *J. Inorganic Biochem.* 93(1-2): 84-91 (2003); Yamanishi et al., *Eur. J. Biochem.* 269: 4484-4494 (2002)), the following regions of the a-subunit of GDH were targeted for regional random mutagenesis: 1) amino acids No. 141-152; 2) amino acids No. 219-226; and 3) amino acids No. 330-342. Since each of these regions was fairly short in length, an oligo-directed mutagenesis approach was used to make these 3 mutant libraries. This involved a multi-step process wherein a silent mutation corresponding to a unique restriction site upstream or downstream of each region to be mutated was first created to facilitate cloning. Then, degenerate oligo-nucleotide primers were prepared and used in PCR reactions to mutagenize the targeted regions of the α-subunit. These mutagenized PCR fragments were then cloned into *E. coli* to create the "PpuMI-library", "4BR1-library", and "RsrII-library".

Introducing Silent Mutations in pGD20

One silent mutation was produced upstream or downstream of each targeted region, for the creation of a unique restriction site in plasmid pGD20. The following pairs of primers were used for making point mutations for each region. The nucleotide shown in capitalized, boldface lettering in each primer shows the location of the specific mutation to be introduced.

TABLE 15

Formation of Silent Mutations within Targeted Amino Acids

| Amino Acid Region | RE Site and Location | Forward Primer | Reverse Primer |
|---|---|---|---|
| a.a.141–a.a.152 | PpuMI; 14 bp upstream of amino acid target region | PGD20RM-F1: 5'-gaa gat gcg tgc ccg cAg gac ccc ctc caa cca-3' (SEQ ID NO: 39) | PGD20RM-R1: 5'-tgg ttg gag ggg gtc cTg cgg gca cgc atc ttc-3' (SEQ ID NO: 40) |
| a.a.219–a.a.226 | HpaI; 4 bp upstream of amino acid target region | TB4BF: 5'-gag ctg ggc atg cgt ggG tta acc agc tac gcc gag-3' (SEQ ID NO: 41) | TB4BR: 5'-ctc ggc gta gct ggt taa Ccc acg cat gcc cag ctc-3' (SEQ ID NO: 42) |
| a.a.330–a.a.342 | RsrII; 11 bp downstream of amino acid target region | pGD20RM-F2: 5'-act cgg ata ttc gcc gGa ccg cgc gca ccc tga-3' (SEQ ID NO: 43) | pGD20RM-R2: 5'-tca ggg tgc gcg cgg tCc ggc gaa tat ccg agt-3' (SEQ ID NO: 44) |

The mutagenesis experiments were carried out using Stratagene's QuikChange site-directed mutagenesis kits (La Jolla, Calif.), according the manufacturers' instructions. Following mutagenesis, plasmid was purified from each mutant clone. The point mutations were confirmed by restriction enzyme digestion, followed by direct DNA sequence analysis.

Oligo-Directed Mutagenesis

To make the regional random mutant libraries, three degenerate oligonucleotides were synthesized (pGD20RM-F3, TB4B-R1, and pGD20RM-R4, as shown below). Normal conditions were used for oligonucleotide synthesis for those nucleotides shown in capital letters. In contrast, nucleotides shown in lowercase, boldface text utilized the degenerate nucleotide mixtures shown beneath each primer during synthesis. Thus, 1-2 point mutations were predicted to result in each "degenerate region" of the primer.

pGD20RM-F3 (for a.a. 141-a.a. 152 region—"PpuMI library"):
  5'-GCC CGC AGG ACC CCC TCC aac cag tgc cac gtc acc aat ctc aaa gat aat ccg GTG CAG ATT-3' (SEQ ID NO:45)
    a=94% A mixed with 2% G, 2% C and 2% T;
    g=94% G mixed with 2% A, 2% C and 2% T;
    c=94% C mixed with 2% G, 2% A and 2% T;
    t=94% T mixed with 2% G, 2% C and 2% A.

TB4B-R1 (for a.a.219-a.a.226 region—"4BR1 library"):
  5'-GCG TGG GTT AAC cag cta cgc cga gac ggt gtc ggt cta cGG CAC CGA AGC GGT ATT TAC C-3' (SEQ ID NO:46)
    a=94% A mixed with 2% G, 2% C and 2% T;
    g=94% G mixed with 2% A, 2% C and 2% T;
    c=94% C mixed with 2% A, 2% T and 2% G;
    t=94% T mixed with 2% A, 2% G and 2% C.

pGD20RM-R4 (for a.a.330-a.a.342 region-"RsrII library"):
  5'-GGT GCG CGC GGT GCG GCG AAT ATC cga gtg gga gaa agt ctg gtc gft ggc gga cgc cac ftc GAG GTC GAG-3' (SEQ ID NO:47)
    a=95% A mixed with 1.66% G, 1.66% C and 1.66% T;
    g=95% G mixed with 1.66% A, 1.66% C and 1.66% T;
    c=95% C mixed with 1.66% G, 1.66% A and 1.66% T;
    t=95% T mixed with 1.66% G, 1.66% C and 1.66% A.

High fidelity PCR reactions were then performed to produce mutagenic PCR fragments using the following primer pairs:
  PpuMI-library: pGD20RM-F3 and DHA-R2 (SEQ ID NOs:45 and 38);
  4BR-1 library: TB4B-R1 and GD-C (SEQ ID NOs:46 and 199);
  RsrII-library: DHA-F1 and pGD20RM-R4 (SEQ ID NOs: 36 and 47).

The PCR fragments were purified from an agarose gel and then digested with PpuM I/Xba I (for the PpuMI-library), HpaI/XbaI (for the 4BR-1 library), and Hind III/Rsr II (for the RsrII-library), respectively.

Mutant Library Construction

The mutated pGD20 construct (in which PpuM 1, HpaI or Rsr II unique restriction enzyme digestion sites had been introduced by site-directed mutagenesis), was digested with PpuM I/Xba I, HpaI/XbaI or Hind III/Rsr II, respectively. The linearized vectors were purified from agarose gels, and then ligated with the restriction enzyme-digested PCR products. Mutant libraries were prepared by electroporating the ligation mixtures into E. coli strain 5K(DE3), as described in Example 7.

Sequencing Analysis for Regional Libraries

Between 9 and 10 mutant colonies were randomly picked for DNA sequencing analysis from each regional library. For the PpuMI-library, the average mutation rate per mutant was 2.8 mutations (n=9). The average mutation rate per mutant was 2.0 mutations in the 4BR1-library (n=8). Finally, sequencing data from the Rsr II library revealed an average mutation rate of 2.2 mutations per mutant (n=10). Neither insertions nor deletions were observed in any of the three libraries. All types of base substitutions were detected, however, indicating lack of bias for any specific mutation type.

Example 9

Screening the GDH Mutant Libraries Created by Random Mutagenesis and Identifying Those Mutants with Reduced Inactivation Kinetics Using the automated two-point high throughput GDH screening assay described in the General Methods, approximately 100,000 mutant colonies from the Xba and Sma libraries (Example 7) and the PpuMI, 4BR1, and RsrII libraries (Example 8) were screened. All putative "hits" from the first screen were confirmed in follow-up assays. Sequence analysis of the mutant genes, followed by comparison with the wild-type gene, permitted identification of the specific point mutations present in each mutant gene.

Screening the Mutant Libraries and Confirming the Hits

Following the primary screening of approximately 100,000 mutants, putative hits were confirmed by a follow-up confirmation assay. Briefly, each putative hit was re-assayed in 8 wells. Results from each individual clone were analyzed statistically to obtain the mean and standard deviation for T1 (the amount of aldehyde measured at 30 sec) and T2 (the amount of aldehyde measured at 40 min). These results were compared to the wild-type enzyme.

FIG. 7 shows a typical follow-up assay result, plotting the number of assays on the x-axis versus the $OD_{670nm}$ on the y-axis. Results from each individual assay (n=8) at T1 and T2 for clone Xba3010 and the wild-type are presented. The mean value is graphically shown as a horizontal line, and numerically presented in parentheses +/−standard deviation. Generally, the standard deviation was about 10-15%.

Screening Results

Table 16 summarizes the follow-up assay results for several hits having either a T2/T1 ratio greater than that of the wild-type, or a T2 greater than that of the wild-type, or both. The T2/T1 ratio provides an indication of enzyme stability during the 40 min reaction, which occurs in the presence of 1,3-propanediol and glycerol. T2 indicates the total turnover number of the enzyme before it becomes completely inactivated. The higher the T2/T1 ratio, the better the enzyme's stability. Thus, a mutant enzyme with improved stability will have a decreased rate of inactivation in the presence of glycerol and 1,3-propanediol, as compared to the wild-type enzyme. In the Table, the mean values of T1 and T2 from follow-up assays are reported, following their normalization to the wild-type results. Table 16 also summarizes the specific point mutations identified in each mutant.

TABLE 16

Summary of GDH Mutants

| Strain | T2/T1 Ratio* | T2 value* | Mutation(s) |
|---|---|---|---|
| Wild-type (control) (SEQ ID NO: 67) | 1 | 1 | none |
| Xba3007 (SEQ ID NO: 71) | 4.30 | 0.78 | ACC(γ-Thr53) to GCC(Ala) |
| Xba3029 (SEQ ID NO: 75) | 3.24 | 0.91 | CTC(α-Leu509) to TTC(Phe) |
| Xba3025 (SEQ ID NO: 79) | 2.77 | 0.84 | ATC(γ-Ile49) to ACC(Thr) |
| Xba3015 (SEQ ID NO: 83) | 2.36 | 1.13 | GTT(α-Val549) to GCT(Ala); CTG(β-Leu113) to CCG(Pro); GCC(γ-Ala122) to GTG(Val); GCG(γ-Ala128) to GTG(Val) |

TABLE 16-continued

Summary of GDH Mutants

| Strain | T2/T1 Ratio* | T2 value* | Mutation(s) |
|---|---|---|---|
| Xba3008 (SEQ ID NO: 87) | 2.12 | 1.15 | TCT(β-Ser122) to CCC(Pro); AAA(β-Lys166) to AGA(Arg) |
| Xba3016 (SEQ ID NO: 91) | 1.72 | 1.18 | ATC(α-Ile102) to ACC(Thr) |
| Xba3020 (SEQ ID NO: 95) | 1.65 | 1.04 | CCG(β-Pro152) to ACG(Thr) |
| Xba3010 (SEQ ID NO: 99) | 1.25 | 1.39 | CTG(α-Leu318) to TTG(Leu); AAG(α-Asn447) to AAT(Asn); AAT(α-Asn489) to AGT(Ser); GCC(β-Ala27) to TCC(Ser) |
| Xba3023 (SEQ ID NO: 103) | 1.00 | 1.22 | GGG(α-Gly63) to GGA(Gly); CAC(α-His96) to CAT(His); ATC(α-Ile102) to GTC(Val) |
| Xba3009 (SEQ ID NO: 107) | 0.98 | 1.61 | ACG(α-Thr77) to GCG(Ala); TGC(α-Cys193) to AGC(Ser); TAA(stop of α) to GAA(Glu); AAA(β-Lys56) to AGA(Arg); GCC(β-Ala88) to GCT(Ala); GAT(β-Asp111) to GAA(Glu); GAT(γ-His67) to TAT(Tyr); ACC(γ-Thr114) to TCC(Ser) |
| Sma3002 (SEQ ID NO: 110) | 2.73 | 1.60 | TAT(α-Tyr271) to TGT(Cys); TAC(α-Tyr502) to CAC(His); TAA(stop of α) to CAA(Gln); CAA(β-Gln2) to CGA(Arg); TTT(β-Phe11) to TTC(Phe) |
| Sma3003 (SEQ ID NO: 113) | 1.95 | 1.16 | ATG(α-Met62) to CTG(Leu) |
| Sma3009 (SEQ ID NO: 117) | 2.75 | 0.71 | ATG(α-Met62) to GTG(Val); ATC(β-Ile63) to GTC(Val); AAA(α-Lys149) to AGA(Arg) |
| Sma3010 (SEQ ID NO: 121) | 2.03 | 0.96 | ATG(α-Met62) to GTG(Val); GCG(β-Ala53) to GTG(Val) |
| Sma3008 (SEQ ID NO: 125) | 1.75 | 0.95 | ATG(α-Met62) to ACG(Thr); CTG(α-Leu268) to CTA(Leu); |
| PpuMI002 (SEQ ID NO: 129) | 2.08 | 0.69 | CGG(α-Arg137) to AGG(Arg); GAT(α-Asp150) to CAT(His) |
| RsrII001 (SEQ ID NO: 133) | 1.92 | 0.72 | TTC(α-Phe339) to GTC(Val); CGC(α-Arg346) to CGG(Arg) |
| 4BR1001 (SEQ ID NO: 137) | 1.90 | 1.10 | GGC(α-Gly216) to GGG(Gly); GTG(α-Val224) to CTG(Leu) |
| KG005 (SEQ ID NO: 141) | 1.62 | 1.33 | ACT(α-Asn288) to ACC(Asn); ATG(α-Met306) to TTG(Leu); CCG(β-Pro152) to TCG(Ser) |

*The T2/T1 ratio and T2 value are relative numbers normalized to the wild-type.

As seen from the sequencing results, most mutations were identified as amino acid substitutions (with the exception of the silent mutations). However, two of the mutants (Sma3002 and Xba3009) were fusion proteins. Specifically, the stop codon (TAA) of the gene encoding the α-subunit (dhaB1) was changed to CAA (Gln) or GAA (Glu) in Sma3002 and Xba3009, respectively. Since there are 15 bp between this stop codon and the initial codon of the gene encoding the β-subunit (dhaB2), neither of these fusion proteins caused frame shifts to occur in the β-subunit. This permitted both mutant enzymes to retain activity. The initial codon (GTG) of the β-subunit is usually recognized by fMet-tRNA; however, in the fusion mutants, this codon should be recognized by Val-tRNA. The Sma3002 fusion protein contained a linker that consists of six amino acid residues: Gln-Gly-Gly-Ile-Pro-Val (SEQ ID NO:48). For the Xba3009 fusion protein, the linker was Glu-Gly-Gly-Ile-Pro-Val (SEQ ID NO:49).

Example 10

Rational Mutagenesis of a Pure Fusion First Generation GDH Mutant

Two fusion mutants, Xba3009 (SEQ ID NO:107) and Sma3002 (SEQ ID NO:110), were described in Example 9. Both contained other mutations, in addition to the fusion itself. In order to investigate the effects of the α- and β-fusion (and hopefully further improve the mutants obtained from the first round of random mutagenesis), two pure fusion mutants (1E1 and 22G7) were constructed.

The stop codon of the wild-type α-subunit (TAA) was changed to CAA (1E1) or GAA (22-G7). This modification was achieved by introducing the single point mutation into the wild-type GDH plasmid. The following two pairs of primers were used for making the point mutations:

For the 1-E1 mutant:

1-E1-F1: 5'-gac acc att gaa Caa ggc ggt att cct-3' (SEQ ID NO:50)

1-E1-R1: 5'-agg aat acc gcc ttG ttc aat ggt gtc-3' (SEQ ID NO:51)

For the 22-G7 mutant:

22-G7-F1:

5'-ccc gac acc att gaa Gaa ggc ggt att cct gtg-3' (SEQ ID NO:52)

22-G7-R1:

5'-cac agg aat acc gcc ttC ttc aat ggt gtc ggg-3' (SEQ ID NO:53)

The nucleotide shown in capitalized, boldface lettering in each primer shows the location of the specific mutation to be introduced.

Mutagenesis experiments were carried out using a Stratagene QuikChange site-directed mutagenesis kit (Stratagene, La Jolla, Calif.), as described in Example 8. The T2/T1 ratio and T2 value of these two mutants were measured as described in the General Methods. These results are shown in Table 17:

TABLE 17

T2/T1 Ratio and T2 Value of Rationally Designed Pure Fusion GDH Mutants

| Mutant | Mutation | T2/T1 ratio* | T2* |
|---|---|---|---|
| WT (SEQ ID NO: 67) | — | 1 | 1 |
| 1-E1 (SEQ ID NO: 145) | TAA(stop of α) to CAA(Gln) | 0.72 | 1.82 |
| 22-G7 (SEQ ID NO: 148) | TAA(stop of α) to GAA(Glu) | 0.75 | 1.79 |

*The T2/T1 ratio and T2 value are relative numbers, normalized to the wild-type enzyme.

To determine whether any of the 3 non-fusion mutations in Sma3002 (SEQ ID NO:110) acted in concert to increase the enzyme's stability in the presence of 1,3-propanediol and glycerol, three additional mutants were made. In each of these mutants, one of the three non-fusion mutations in Sma3002 (α-Y271C, α-Y502H, or β-Q2R) was removed, by introducing the wild-type DNA sequence as a single point mutation. This resulted in three Sma3002-derived mutants, each containing 2 of the original non-fusion mutations present in Sma3002. Single point mutations were introduced into the Sma3002 plasmid, using the Stratagene QuikChange site-directed mutagenesis kit (Example 8) and the primers shown in Table 18 below.

TABLE 18

Rationally Designed GDH Mutants, Derived from Mutant Sma3002

| Mutant | Mutation Removed from Sma3002 | Forward Primer | Reverse Primer |
|---|---|---|---|
| 8-C9 | α-Y271C | 8-C9-F1 (SEQ ID NO: 54) | 8-C9-R1 (SEQ ID NO: 55) |
| 9-D7 | α-Y502H | 9-D7-F1 (SEQ ID NO: 56) | 9-D7-R1 (SEQ ID NO: 57) |
| 10-G6 | β-Q2R | 10-G6-F1 (SEQ ID NO: 58) | 10-G6-R1 (SEQ ID NO: 59) |

The T2/T1 ratio and T2 values of these mutants were measured as described in Example 5. Table 19 shows the results of this analysis.

TABLE 19

T2/T1 Ratio and T2 Value of Rationally Designed Sma3002-Derived GDH Mutants

| Mutant | Mutation Removed from Sma3002 | T2/T1 ratio* | T2* |
|---|---|---|---|
| WT (SEQ ID NO: 67) | — | 1 | 1 |
| Sma3002 (SEQ ID NO: 110) | — | 2.7 | 1.6 |
| 8-C9 (SEQ ID NO: 151) | α-Y271C | 1.3 | 1.85 |
| 9-D7 (SEQ ID NO: 154) | α-Y502H | 0.98 | 1.57 |
| 10-G6 (SEQ ID NO: 157) | β-Q2R | 2.56 | 1.55 |

*The T2/T1 ratio and T2 value are relative numbers, normalized to the wild-type enzyme.

Example 11

Site-Saturation Mutagenesis of GDH Mutants

Three mutation sites present in the mutants characterized in Example 9 were subjected to site-saturation mutagenesis. Specifically, these sites were: γ-Thr53 (found in mutant Xba3009), α-Leu509 (found in mutant Xba3029) and α-Val224 (found in mutant 4BR1001). To prepare the saturation mutagenesis libraries, the 1-E1 and 8-C9 mutants (Example 10) were purified from their host cells and used as templates, along with the degenerate primers shown below in Table 20.

TABLE 20

Saturation Mutagenesis libraries

| Library Name | Saturation Mutagenesis Site(s) | Template | Degenerate Primer |
|---|---|---|---|
| GDH-SM1 | γ-T53 | 1-E1 | T53-SM-for: 5'-tg cgg atc tcc cgc cag NNN ctt gag tac cag g-3' (SEQ ID NO: 60) |
| GDH-SM2 | α-L509 | 1-E1 | L509-SM-for: 5'-ctg cag acc tcg gcc att NNN gat cgg cag ttc gag gtg-3' (SEQ ID NO: 61) |
| GDH-SM3 | α-V224 | 8-C9 | V224-SM-for: 5'-agc tac gcc gag acg NNN tcg gtc tac ggc acc-3' (SEQ ID NO: 62) |
| GDH-SM4 | α-L509 and γ-T53 | 1-E1 | L509-SM-for: (SEQ ID NO: 61); and T53-SM-for: (SEQ ID NO: 60) |

Mutagenesis experiments were carried out using the Stratagene QuikChange Multi Site Directed Mutagenesis Kit (Stratagene, La Jolla, Calif.) according to manufacturers' instructions, to prepare the GDH-SM1, GDH-SM2, GDH-SM3, and GDH-SM4 libraries. Following electroporation of the plasmids into *E. coli* strain 5K(DE3) (as described in Example 7), 88 mutant colonies from each library were screened using the one-point GDH assay (see General Methods). Specifically, this assay measures the T(600) (total enzyme turnover number) in the presence of high concentrations of 1,3-propanediol (600 mM). The best hit from each screen was then subjected to DNA sequence analysis. The following Table shows the results:

TABLE 21

T(600) Values and Mutations of Four Saturation Mutants

| Mutant | Origin of Mutant | Mutation | T(600)* |
|---|---|---|---|
| WT (SEQ ID NO: 67) | — | — | 1 |
| Sma3002 (SEQ ID NO: 110) | Example 9, created by error-prone PCR | TAT(α-Tyr271) to TGT(Cys); TAC(α-Tyr502) to CAC(His); TAA(stop of α) to CAA(Gln); CAA(β-Gln2) to CGA(Arg); TTT(β-Phe11) to TTC(Phe) | 3.3 |
| Xba3007 (SEQ ID NO: 71) | Example 9, created by error-prone PCR | ACC(γ-Thr53) to GCG(Ala) | 0.7 |
| Xba3029 (SEQ ID NO: 75) | Example 9, created by error-prone PCR | CTC(α-Leu509) to TTC(Phe) | 1.4 |
| 4BR1001 (SEQ ID NO: 137) | Example 9, created by error-prone PCR | GGC(α-Gly216) to GGG(Gly); GTG(α-Val224) to TTG(Leu) | 2.4 |
| 8-C9 (SEQ ID NO: 151) | Example 10, created by rational design and derived from Sma3002 | TAC(α-Tyr502) to CAC(His); TAA(stop of α) to CAA(Gln); CAA(β-Gln2) to CGA(Arg); TTT(β-Phe11) to TTC(Phe) | 3.1 |
| 1-E1 (SEQ ID NO: 145) | Example 10, created by rational design and derived from Sma3002 | TAA(stop of α) to CAA(Gln) | 2.2 |
| GDH-SM1-G11 (SEQ ID NO: 160) | Present Example created by saturation mutagenesis | TAA(stop of α) to CAA(Gln); ACC(γ-Thr53) to TCC(Ser) | 4.3 |

TABLE 21-continued

T(600) Values and Mutations of Four Saturation Mutants

| Mutant | Origin of Mutant | Mutation | T(600)* |
|---|---|---|---|
| GDH-SM2-B11 (SEQ ID NO: 163) | Present Example created by saturation mutagenesis | TAA(stop of α) to CAA(Gln); CTC(α-Leu509) to TTT(Phe) | 4.1 |
| GDH-SM3-D2 (SEQ ID NO: 166) | Present Example created by saturation mutagenesis | GTG(α-Val224) to TTG(Leu); TAC(α-Tyr502) to CAC(His); TAA(stop of α) to CAA(Gln); CAA(β-Gln2) to CGA(Arg); TTT(β-Phe11) to TTC(Phe) | 4.0 |
| GDH-SM4-H2 (SEQ ID NO: 169) | Present Example created by saturation mutagenesis | TAA(stop of α) to CAA(Gln); ACC(γ-Thr53) to TGT(Cys) | 4.1 |

*The T(600) values are relative numbers normalized to the wild-type.

All four saturation mutants (GDH-SM1-G11, GSH-SM2-B11, GDH-SM3-D2, and GDH-SM4-H2, each shown in bold text above) showed further improvements in T(600), as compared to the parent mutant genes from which they were derived.

Example 12

Improving Enzyme Stability and Rate of Inactivation of GDH Mutants Using the Unpaired Primer Method for Recombination of 24 Parent Genes Despite significant improvements in the GDH rate of inactivation in the presence of glycerol and 1,3-propanediol using random mutagenesis, rational design mutagenesis, and saturation mutagenesis (Examples 7-11), further improvements were desirable for industrial applications. Thus, 24 glycerol dehydratase mutants from Examples 9-11 were utilized as parent templates in a single recombinogenic extension reaction using the unpaired primers method disclosed herein.

Attaching a Short Flanking DNA Fragment to the 5' or 3' End of Parent Genes

A short flanking DNA fragment was attached to the 5' or 3' end of parent genes by PCR, which was subsequently used as the binding sites for the recombinogenic extension method using unpaired primers. These short flanking DNA fragments were additionally useful in order to ensure that the resulting mutant library would not be contaminated with any trace amounts of the parent templates. Specifically, this was accomplished by designing a short flanking fragment for attachment to the 5' region of parent templates that contained a unique Hind III restriction enzyme site; in contrast, those short flanking DNA fragments attached to 3' region of parent templates possessed a unique Xba/restriction enzyme site. Since those template molecules with a short flanking DNA fragment attached to the 5' region did not contain a Xba I site, and templates with a short flanking DNA fragment attached to the 3' region did not have a Hind III site, this enabled distinction between parent templates (none of which could be cleaved with both HindIII and Xba I) and recombinant products (all of which contained both HindIII and Xba I sites, thereby permitting rapid cloning into expression vectors cleaved with HindIII and Xba I). Thus, the resulting mutant library did not contain any trace amounts of parent template contamination. Plasmids containing GDHs were purified from host cells and used as templates in standard high fidelity PCR reactions, using the methodology described in Example 1.

Specifically, forward primer GDHM-F1 (SEQ ID NO:63) and reverse primer GDHM-R1 (SEQ ID NO:64) were used to amplify the following 11 template genes: 1-E1 (SEQ ID NO:145), wild-type GDH (SEQ ID NO:67), Xba3023 (SEQ ID NO:103), Xba3010 (SEQ ID NO:99), 8-C9 (SEQ ID NO:151), 4BR1001 (SEQ ID NO:137), Xba3015 (SEQ ID NO:83), Xba3008 (SEQ ID NO:87), Sma3003 (SEQ ID NO:113), Xba3016 (SEQ ID NO:91) and Xba3020 (SEQ ID NO:95). The resulting PCR products were then mixed together in an equal molar ratio, and designated as "mixture-1".

Forward primer GDHM-F2 (SEQ ID NO:65) and reverse primer GDHM-R2 (SEQ ID NO:66) were used to amplify the following 13 genes: Xba3007 (SEQ ID NO:71), Xba3029 (SEQ ID NO:75), Xba3025 (SEQ ID NO:79), Sma3009 (SEQ ID NO:117), Sma3010 (SEQ ID NO:121), Sma3008 (SEQ ID NO:125), RsrII 1001 (SEQ ID NO:133), PpuMI002 (SEQ ID NO:129), KG005 (SEQ ID NO:141), GDH-SM1-G11 (SEQ ID NO:160), GDH-SM2-B11 (SEQ ID NO:163), GDH-SM3-D2 (SEQ ID NO:166) and GDH-SM4-H2 (SEQ ID NO:169). The resulting PCR products were then mixed together in an equal molar ratio, and designated as "mixture-2".

The amplified products were purified from agarose gels (as described in Example 1), and then used as the parent templates for the recombinogenic extension method with unpaired primers.

Making Recombinogenic Mutant Products Using the Unpaired Primers Method

Recombinogenic products (i.e., GDH mutant genes) were made from the above-mentioned 24 parent templates using two primers: PADH316F1 (SEQ ID NO:29) and T7T (SEQ ID NO:30), as described in Example 1. PADH316F1 anneals with the 5' end of those templates in "mixture-1" (i.e., 1-E1, wild-type GDH, Xba3023, Xba3010, 8-C9, 4BR1001, Xba3015, Xba3008, Sma3003, Xba3016 and Xba3020), due to the addition of the short 5' DNA fragment produced by SEQ ID NO:63. However, primer PADH316F1 does not bind to the 5' end of the "mixture-2" templates. In like manner, primer T7T anneals to the 3' end of the "mixture-2" templates (i.e., Xba2007, Xba3029, Xba3025, Sma3009, Sma3010, Sma3008, RsrII1001, PpuMI002, KG005, GDH-SM1-G11, GDH-SM2-B11, GDH-SM3-D2 and GDH-SM4-H2), but does not bind to the 3' end of the "mixture-1" templates.

The following reaction mixture was assembled for the reaction: 10 ng "mixture-1", 10 ng "mixture-2", 200 μM each dNTP, 1×PCR Buffer (with 1.5 mM MgCl$_2$, as the final concentration), 286 nM pADH316F1, 286 nM T7T, 0.625 U HotStarTaq (Qiagen, Valencia, Calif.), and dH$_2$O to 25 μl. Thermal cycling conditions were: 95° C. denaturation for 2 min; followed by 60 cycles of 30 sec at 95° C., 1 sec+1 sec per cycle at a gradient between 63-69° C.; 72° C. final extension for 7 min; and hold at 4° C. An Eppendorf Mastercycler gradient 5331 (Eppendorf Scientific, Inc., Westbury, N.Y.) was used for the thermal cycling reactions. The recombinant GDH mutant gene products were obtained around 66-67° C.

Making and Screening the Recombinogenic Mutant Library

The recombinant GDH DNA products (approximately 2.7 kB) were purified from a gel using a Qiagen DNA extraction kit, digested with Xba I and Hind III, and then ligated into the XbaI-HindIII-digested pGD20 vector (Example 7). The mutant library was obtained by transformation of the ligation mixture into *E. coli* strain 5K(DE3) by electroporation, as described in Example 7. The library size was over 0.3 million colonies per ligation reaction.

Between 6,000-7,000 mutant colonies were picked from agarose plates and screened using the one-point high throughput GDH screening assay, as described in the General Methods. Following the primary screening, putative hits were confirmed by a follow-up confirmation assay. Briefly, each putative hit was re-assayed in 8 wells. Results from each individual clone were analyzed statistically to obtain the mean and standard deviation for T(600) (total enzyme turnover number in the presence of high concentration of 1,3-propanediol). These results were compared to the wild-type GDH enzyme.

Additionally, several hits were further investigated using the two-point GDH assay (General Methods) to roughly estimate the change of initial reaction rate and inactivation for these hits. As described previously, the T1 value roughly reflects the $k_{cat}$ of the enzyme; the T2 value indicates the total enzyme turnover number; and the T2/T1 ratio shows the stability of the enzyme (e.g., a decrease in enzyme inactivation will result in an increase the T2/T1 ratio).

Table 22 summarizes the results of these various assays for several recombinogenic GDH mutants.

TABLE 22

Characterization of Recombinogenic Mutants Obtained in the 24 Gene Recombination Experiment

| Mutant | T(600)* | T1* | T2* | T2/T1 ratio* |
|---|---|---|---|---|
| WT | 1.0 | 1.00 | 1.00 | 1.00 |
| SHGDH37 | 6.6 | 0.51 | 2.79 | 5.47 |
| SHGDH51 | 6.2 | 0.19 | 2.63 | 13.84 |
| SHGDH12 | 5.9 | 0.64 | 3.46 | 5.41 |
| SHGDH22 | 5.8 | 0.50 | 3.42 | 6.84 |
| SHGDH38 | 5.7 | — | — | — |
| SHGDH24 | 5.6 | 1.05 | 2.29 | 2.18 |
| SHGDH43 | 5.6 | 0.22 | 2.11 | 9.59 |
| SHGDH25 | 5.1 | — | — | — |
| SHGDH29 | 4.6 | 0.49 | 2.14 | 4.37 |

*The T(600), T1, T2, and T2/T1 values are relative numbers normalized to the wild-type.

Although different recombinant GDH mutants displayed different enzyme kinetics (despite having similar T(600) values), this merely reflects differences in the parameters that each assay measures. For example, mutants SHGDH24 and SHGDH43 possessed identical T(600) values, but SHGDH24 had only a slightly improved T1 value compared with wild-type while SHGDH43 had a largely reduced T1. In the case of SHGDH24, the $k_{cat}$ of the enzyme was not decreased; in contrast, SHGDH43 had a $k_{cat}$ that was greatly reduced. In either case, the GDH enzyme stability of both SHGDH24 and SHGDH43 was increased, thus enabling improvement in the total enzyme turnover number.

The results clearly demonstrated substantial improvement in GDH stability, due to the creation of new mutants using the unpaired primer method. Specifically, the best mutant obtained via random mutagenesis (Example 9) had a T(600) of 3.3 (i.e., mutant Sma3002); rational combination of mutants identified through random mutagenesis and screening or semi-random combination of these mutations using site-saturation mutagenesis (Examples 10 and 11) yielded a mutant with a maximum T(600) of 4.3 (i.e., mutant GDH-SM1-G11). In contrast, the best T(600) value was 6.6, for the mutants created by the unpaired primers method. Thus, it is concluded that the random recombination approach using the recombinogenic extension method using unpaired primers of the present invention is a more powerful technique than previous rational and semi-random approaches.

Sequence Analysis of the Mutant Genes

Plasmid DNA was purified from the recombinant GDH mutants listed in Table 22 and the entire GDH gene in each was sequenced. Analysis of the mutants, followed by comparison to the original wild-type GDH gene sequence, indicated that these recombinant mutant genes contained the following single base substitution mutations (point mutations):

TABLE 23

DNA sequence analysis of Recombinogenic GDH Mutants

| Strain | Mutations |
|---|---|
| SHGDH12 (SEQ ID NO: 178) | GTT(α-Val74) to ATT(Ile); GTG(α-Val224) to TTG(Leu); CGC(α-Arg425) to CGT(Arg); TAC(α-Tyr502) to CAC(His); TAA(stop of α) to CAA(Gln); CAA(β-Gln2) to CGA(Arg); TTT(β-Phe11) to TTC(Phe); AAA(β-Lys14) to AGA(Arg) |
| SHGDH22 (SEQ ID NO: 181) | GGC(α-Gly216) to GGG(Gly); GTG(α-Val224) to TTG(Leu); CAG(α-Gln337) to CAA(Gln); CGC(α-Arg533) to GGC(Gly); ACC(α-Thr553) to ACG(Thr); TAA(stop of α) to CAA(Gln); ATC(γ-Ile21) to ACC(Thr); CTG(γ-Leu137) to CTA(Leu) |
| SHGDH24 (SEQ ID NO: 187) | CGT(α-Arg134) to CGC(Arg); GGC(α-Gly216) to GGG(Gly); GTG(α-Val224) to TTG(Leu); AGC(α-Ser481) to AGT(Ser); ACC(α-Thr553) to ACG(Thr); TAA(stop of α) to CAA(Gln) |
| SHGDH25 (SEQ ID NO: 193) | ATG(α-Met62) to CTG(Leu); GTG(α-Val124) to GCG(Ala); GGC(α-Gly216) to GGG(Gly); GTG(α-Val224) to TTG(Leu); TAA(stop of α) to CAA(Gln) |
| SHGDH29 (SEQ ID NO: 196) | GCC(α-Ala376) to GCT(Ala); CTC(α-Leu509) to TTT(Phe); ACC(α-Thr553) to ACG(Thr); TAA(stop of α) to CAA(Gln); CAG(γ-Gln101) to CGG(Arg) |
| SHGDH37 (SEQ ID NO: 172) | GTG(α-Val224) to TTG(Leu); TAC(α-Tyr502) to CAC(His); TAA(stop of α) to CAA(Gln); CAA(β-Gln2) to CGA(Arg); TTT(β-Phe11) to TTC(Phe); GAG(γ-Glu35) to AAG(Lys) |
| SHGDH38 (SEQ ID NO: 184) | GTG(α-Val224) to TTG(Leu); TAC(α-Tyr502) to CAC(His); TAA(stop of α) to CAA(Gln); CAA(β-Gln2) to CGA(Arg); TTT(β-Phe11) to TTC(Phe); GGG(β-Gly19) to GAG(Glu); GAA(β-Glu64) to GAG(Glu); CTT(β-Leu67) to CTC(Leu); AAT(γ-Asn72) to AGT(Ser) |
| SHGDH43 (SEQ ID NO: 190) | GGC(α-Gly216) to GGG(Gly); GTG(α-Val224) to TTG(Leu); GAG(α-Glu240) to GAA(Glu); GTG(α-Val301) to GTA(Val); ACC(α-Thr553) to ACG(Thr); TAA(stop of α) to CAA(Gln); AAA(β-Lys166) to AGA(Arg); AAA(β-Lys173) to GAA(Glu); ACC(γ-Thr53) to TCC(Ser) |

TABLE 23-continued

DNA sequence analysis of Recombinogenic GDH Mutants

| Strain | Mutations |
|---|---|
| SHGDH51 (SEQ ID NO: 175) | TTC(α-Phe339) to GTC(Val); CGC(α-Arg346) to CGG(Arg); ACC(α-Thr553) to ACG(Thr); TAA(stop of α) to CAA(Gln); CCC(β-Pro184) to CCT(Pro); ACC(γ-Thr53) to GCC(Ala) |

Interestingly, all the mutants (SEQ ID NOs:172, 175, 178, 181, 184, 187, 190, 193, and 196) contained an α-β fusion mutation (as originally discovered in the Sma3002 and Xba3009 mutants [Example 9]), indicating that this mutation is very important for T(600) value improvement. SHGDH43 contained mutations from four different parent genes (i.e., 4BR1001, 1-E1, Xba3008 and GDH-SM1-G11), in addition to four newly created mutations. This indicated that at least four crossovers occurred among the four different parent genes during the recombinogenic PCR. SHGDH25 and SHGDH51 contained mutations from three parent genes (i.e., Sma3003, 4BR1001 and 1-E1 for SHGDH25; RsrII001, 1-E1 and Xba3007 for SHGDH51), in addition to several newly created mutations.

These results confirmed that the unpaired primer method has good recombination efficiency. Additionally, since each of the 9 GDH mutants of Table 23 possessed "new" mutations that were not found in any of the parent templates, this confirmed previous conclusions that the unpaired primer method can readily introduce new mutations into the recombinogenic products. Finally, the robustness of the recombinogenic extension method using unpaired primers disclosed herein is confirmed, based on the technique's successful recombination of 24 parent genes in a single extension reaction.

Example 13

Incorporating a Template-Nicking Approach into the Unpaired Primer Method

Marton et al. (*Nucl. Acids Res.* 19(9):2423-2426 (1991)) have reported that DNA nicking favors PCR recombination. Specifically, they have found that use of templates nicked by DNAse increases the in vitro recombination between two templates during a PCR reaction. Therefore, this template-nicking approach could readily be incorporated into the techniques applied herein for recombinogenic extension using unpaired primers.

A short DNA fragment is attached to the 5' end of template(s) A, or to the 3' end of template(s) B using a standard high fidelity PCR reaction (as described in Example 1), thus allowing the two DNA templates' use for recombinogenic extension using unpaired primers. Prior to recombinogenic extension, however, templates A and B are treated with DNAse, using methodology well known to one of skill in the art. The treatment is stopped just before the templates become fragmented, so that the DNA templates contain sufficient nicking sites without suffering from fragmentation. The DNAse-treated DNA templates are then gel-purified. The recombinant extension reaction using unpaired primers is performed as described in Example 1 using these DNAse-treated DNA templates. The recombinant efficiency obtained in the mutants created by the unpaired primer method using nicked templates will be higher than that obtained using untreated DNA templates.

SEQUENCE LISTING (203 sequences)

SEQ ID NO: 1 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgactcgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctgtctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggaaggtctcggtctcgtcaacggcaccgccgtctcagcatcgatggccaccctcgctctgcacgacgctcacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgatcgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacgcctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 2 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRAIEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 3 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgactcgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacgcctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 4 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 5 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgagggcgccatctcgctccagaaggctctcctcgagcacctgctctgcggtgttctcccttcgtcgttcgactcgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacgcctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 6 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEGAISLQKALLEHLLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 7 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgacccgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccgtcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacgcctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 8 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDPFRLGRGLENSLPLEVVRGAMTIRVNSLTRGHSAVRLVVLEALTNFLNHGITPVVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 9 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgactcgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcgggcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacgcctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 10 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAGNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 11 - DNA, 2151 bp, Rhodosporidium glutinis
atggcaccctcgctcgactcgatctcgcactcgttcgcaaacggcgtcgcatccgcaaagcaggctgtcaatggcgccccgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggtcgccatctcgctccagaaggctctcctcgagcaccagctctgcggtgttctcccttcgtcgttcgactcgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgccacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacacctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 12 - protein, 716 aa, Rhodosporidium glutinis
MAPSLDSISHSFANGVASAKQAVNGAPTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEVAISLQKALLEHQLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDATRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNTWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 13 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgactcgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccgcggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacgcctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 14 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHRGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 15 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgacccgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacgcctggaaggtcgccgccgccgagtcggccatctcgctcacccgccaagtccgcgagaccttctggtccgccgcgtcgacctcgtcgcccgcgctctcgtacctctcgccgcgtactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 16 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDPFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 17 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgacccgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgccacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacacctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 18 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDPFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDATRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNTWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 19 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgacccgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgccacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgaattcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacacctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcagggtcaacaacgtcctcctcaagatgctcgcttag

SEQ ID NO: 20 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDPFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDATRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNTWKVAAAESAISLTRQVRETFWSAASTSSPALSYLSPRTQILYAFVREELGVKARRGDVFLGKQEVTIGSNVSKIYEAIKSGRVNNVLLKMLA

SEQ ID NO: 21 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgactcgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgttcccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcaaggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacacctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 22 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVKDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNTWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 23 - DNA, 2151 bp, Rhodosporidium glutinis
atggcaccctcgctcgactcgatctcgcactcgttcgcaaacggcgtcgcatccgcaaagcaggctgtcaatggcgcctcgaccaacctcgcagtcgcaggctcgcacctgcccacaacccaggtcacgcaggtcgacatcgtcgagaagatgctcgccgcgccgaccgactcgacgctcgaactcgacggctactcgctcaacctcggagacgtcgtctcggccgcgaggaagggcaggcctgtccgcgtcaaggacagcgacgagatccgctcaaagattgacaaatcggtcgagttcttgcgctcgcaactctccatgagcgtctacggcgtcacgactggatttggcggatccgcagacacccgcaccgaggacgccatctcgctccagaaggctctcctcgagcaccagctctgcggtgttctcccttcgtcgttcgactcgttccgcctcggccgcggtctcgagaactcgcttcccctcgaggttgttcgcggcgccatgacaatccgcgtcaacagcttgacccgcggccactcggctgtccgcctcgtcgtcctcgaggcgctcaccaacttcctcaaccacggcatcacccccatcgtccccctccgcggcaccatctctgcgtcgggcgacctctctcctctctcctacattgcagcggccatcagcggtcacccggacagcaaggtgcacgtcgtccacgagggcaaggagaagatcctgtacgcccgcgaggcgatggcgctcttcaacctcgagcccgtcgtcctcggcccgaaggagggtctcggtctcgtcaacggcaccgccgtctcagcatcgatggccaccctcgctctgcacgacgcacacatgctctcgctcctctcgcagtcgctcacggccatgacggtcgaagcgatggtcggccacgccggctcgttccaccccttccttcacgacgtcacgcgccctcacccgacgcagatcgaagtcgcgggaaacatccgcaagctcctcgagggaagccgctttgctgtccaccatgaggaggaggtcaaggtcagggacgacgagggcattctccgccaggaccgctaccccttgcgcacgtctcctcagtggctcggcccgctcgtcagcgacctcattcacgcccacgccgtcctcaccatcgaggccggccagtcgacgaccgacaaccctctcatcgacgtcgagaacaagacttcgcaccacggcggcaatttccaggctgccgctgtggccaacaccatggagaagactcgcctcgggctcgcccagatcggcaagctcaacttcacgcagctcaccgagatgctcaacgccggcatgaaccgcggcctcccctcctgcctcgcggccgaagacccctcgctctcctaccactgcaagggcctcgacatcgccgctgcggcgtacacctcggagttgggacacctcgccaaccctgtgacgacgcatgtccagccggctgagatggcgaaccaggcggtcaactcgcttgcgctcatctcggctcgtcgcacgaccgagtccaacgacgtcctttctctcctcctcgccacccacctctactgcgttctccaagccatcgacttgcgcgcgaccgagttcgagttcaagaagcagttcggcccagccatcgtctcgctcatcgaccagcactttggctccgccatgaccggctcgaacctgcgcgacgagctcgtcgagaaggtgaacaagacgctcgccaagcgcctcgagcagaccaactcgtacgacctcgtcccgcgctggcacgacgccttctccttcgccgccggcaccgtcgtcgaggtcctctcgtcgacgtcgctctcgctcgccgccgtcaacgcctggaaggtcgccgccgccgagtcggccatctcgctcacccgccaagtccgcgagaccttctggtccgccgcgtcgacctcgtcgcccgcgctctcgtacctctcgccgcgcactcagatcctctacgccttcgtccgcgaggagcttggcgtcaaggcccgccgcggagacgtcttcctcggcaagcaagaggtgacgatcggctcgaacgtctccaagatctacgaggccatcaagtcgggcaggatcaacaacgtcctcctcaagatgctcgcttag

SEQ ID NO: 24 - protein, 716 aa, Rhodosporidium glutinis
MAPSLDSISHSFANGVASAKQAVNGASTNLAVAGSHLPTTQVTQVDIVEKMLAAPTDSTLELDGYSLNLGDVVSAARKGRPVRVKDSDEIRSKIDKSVEFLRSQLSMSVYGVTTGFGGSADTRTEDAISLQKALLEHQLCGVLPSSFDSFRLGRGLENSLPLEVVRGAMTIRVNSLTRGHSAVRLVVLEALTNFLNHGITPIVPLRGTISASGDLSPLSYIAAAISGHPDSKVHVVHEGKEKILYAREAMALFNLEPVVLGPKEGLGLVNGTAVSASMATLALHDAHMLSLLSQSLTAMTVEAMVGHAGSFHPFLHDVTRPHPTQIEVAGNIRKLLEGSRFAVHHEEEVKVRDDEGILRQDRYPLRTSPQWLGPLVSDLIHAHAVLTIEAGQSTTDNPLIDVENKTSHHGGNFQAAAVANTMEKTRLGLAQIGKLNFTQLTEMLNAGMNRGLPSCLAAEDPSLSYHCKGLDIAAAAYTSELGHLANPVTTHVQPAEMANQAVNSLALISARRTTESNDVLSLLLATHLYCVLQAIDLRATEFEFKKQFGPAIVSLIDQHFGSAMTGSNLRDELVEKVNKTLAKRLEQTNSYDLVPRWHDAFSFAAGTVVEVLSSTSLSLAAVNAWKVAAAESAISLTRQVRETFWSAASTSSPALSYLSPRTQILYAFVREELGVKARRGDVFLGKQEVTIGSNVSKIYEAIKSGRINNVLLKMLA

SEQ ID NO: 25 - DNA, 54 bp, Artificial Sequence
  Primer 2000YF1
tttcaagctataccaagcatacaatgaactagtatggcaccctcgctcgactcg

SEQ ID NO: 26 - DNA, 21 bp, Artificial Sequence
  Primer 18-3'
aactgcagctaagcgagcatc

SEQ ID NO: 27 - DNA, 21 bp, Artificial Sequence
  Primer 18-5'
tagctctagaatggcaccctc

SEQ ID NO: 28 - DNA, 49 bp, Artificial Sequence
  Primer 2000YR19T7T
gctagttattgctcagcggcccctcgagctgcagctaagcgagcatctt

SEQ ID NO: 29 - DNA, 24 bp, Artificial Sequence
  Primer PADH316F1
caagctataccaagcatacaatga

SEQ ID NO: 30 - DNA, 19 bp, Artificial Sequence
  Primer T7T
gctagttattgctcagcgg

SEQ ID NO: 31 - DNA, 21 bp, Artificial Sequence
  Primer 18-3'AC
aactgccgctaagcgagcatc

SEQ ID NO: 32 - DNA, 12145 bp, Klebsiella pneumoniae
  CDS (7044)..(8711): DhaB1
  CDS (8724)..(9308): DhaB2
  CDS (9311)..(9736): DhaB3
  ref <302>: TITLE: Improved Process for the Biological Production of 1,3-Propanediol with High Titer
  ref <310>: PATENT DOCUMENT NUMBER: WO 2001012833 A2
  ref <311>: PATENT FILING DATE: 2000-08-18
  ref <312>: PUBLICATION DATE: 2001-02-22
  ref <313>: RELEVANT RESIDUES: (1)..(12145)
gtcgaccaccacggtggtgactttaatgccgctctcatgcagcagctcggtggcggtctcaaaattcaggatgtcgccggtatagtttttgataatcagcaagacgccttcgccgccgtcaatttgcatcgcgcattcaaacattttgtccggcgtcggcgaggtgaatatttcccccggacaggcgccggagagcatgccctggccgatatagccgcagtgcatcggttcatgtccgctgccgccgccggagagcagggccaccttgccagccaccggcgcgtcggtgcgggtcacatacagcgggtcctgatgcagggtcagctgcggatgggctttagccagcccctgtaattgttcattcagtacatcttcaacacggttaatcagctttttcattattcagtgctccgttggagaaggttcgatgccgcctctctgctggcggaggcggtcatcgcgtaggggtatcgtctgacggtggagcgtgcctggcgatatgatgattctggctgagcggacgaaaaaaagaatgccccgacgatcgggtttcattacgaaacattgcttcctgattttgtttctttatggaacgtttttgctgaggatatggtgaaaatgcgagctggcgcgctttttttcttctgccataagcggcggtcaggatagccggcgaagcgggtgggaaaaaattttttgctgattttctgccgactgcgggagaaaaggcggtcaaacacggaggattgtaagggcattatgcggcaaaggagcggatcgggatcgcaatcctgacagagactagggttttttgttccaatatggaacgtaaaaaattaacctgtgtttcatatcagaacaaaaaggcgaaagatttttttgttccctgccggccctacagtgatcgcactgctccggtacgctccgttcaggccgcgcttcactggccggcgcggataacgccagggctcatcatgtctacatgcgcacttatttgagggtgaaaggaatgctaaaagttattcaatctccagccaaatatcttcagggtcctgatgctgctgttctgttcggtcaatatgccaaaaacctggcggagagcttcttcgtcatcgctgacgatttcgtaatgaagctggcgggagagaaagtggtgaatggcctgcagagccacgatattcgctgccatgcggaacggtttaacggcgaatgcagccatgcggaaatcaaccgtctgatggcgattttgcaaaaacagggctgccgcggcgtggtcgggatcggcggtggtaaaaccctcgataccgcgaaggcgatcggttactaccagaagctgccggtggtggtgatcccgaccatcgcctcgaccgatgcgccaaccagcgcgctgtcggtgatctacaccgaagcgggcgagtttgaagagtatctgatctatccgaaaaacccggatatggtggtgatggacacggcgattatcgccaaagcgccggtacgcctgctggtctccggcatgggcgatgcgctctccacctggttcgaggccaaagcttgctacgatgcgcgcgccaccagcatggccggaggacagtccaccgaggcggcgctgagcctcgcccgcctgtgctatgatacgctgctggcggagggcgaaaaggcccgtctggcggcgcaggccggggtagtgaccgaagcgctggagcgcatcatcgaggcgaacacttacctcagcggcattggctttgaaagcagtggcctggccgctgcccatgcaatccacaacggtttcaccattcttgaagagtgccatcacctgtatcacggtgagaaagtggccttcggtaccctggcgcagctggtgctgcagaacagcccgatggacgagattgaaacggtgcagggcttctgccagcgcgtcggcctgccggtgacgctcgcgcagatgggcgtcaaagaggggatcgacgagaaaatcgccgcggtggcgaaagctacctgcgcggaaggggaaaccatccataatatgccgtttgcggtgaccccggagagcgtccatgccgctatcctcaccgccgatctgttaggccagcagtggctggcgcgttaattcgcggtggctaaaccgctggcccaggtcagcggtttttctttctcccctccggcagtcgctgccggaggggttctctatggtacaacgcggaaaaggatatgactgttcagactcaggataccgggaaggcggtctcttccgtcattgcccagtcatggcaccgctgcagcaagtttatgcagcgcgaaacctggcaaacgccgcaccaggcccagggcctgaccttcgactccatctgtcggcgtaaaaccgcgctgctcaccatcggccaggcggcgctggaagacgcctgggagtttatggacggccgcccctgcgcgctgtttattcttgatgagtccgcctgcatcctgagccgttgcggcgagccgcaaaccctggcccagctggctgccctgggatttcgcgacggcagctattgtgcggagagcattatcggcacctgcgcgctgtcgctggccgcgatgcagggccagccgatcaacaccgccggcgatcggcattttaagcaggcgctacagccatggagtttttgctcgacgccggtgtttgataaccacgggcggctgttcggctctatctcgctttgctgtctggtcgagcaccagtccagcgccgacctctccctgacgctggccatcgcccgcgaggtgggtaactccctgcttaccgacagcctgctggcggaatccaaccgtcacctcaatcagatgtacggcctgctggagagcatggacgatggggtgatggcgtggaacgaacagggcgtgctgcagtttctcaatgttcaggcggcgagactgctgcatcttgatgctcaggccagccaggggaaaaatatcgccgatctggtgaccctcccggcgctgctgcgccgcgccatcaaacacgcccgcggcctgaatcacgtcgaagtcacctttgaaagtcagcatcagtttgtcgatgcggtgatcaccttaaaaccgattgtcgaggcgcaaggcaacagttttattctgctgctgcatccggtggagcagatgcggcagctgatgaccagccagctcggtaaagtcagccacacctttgagcagatgtctgccgacgatccggaaacccgacgcctgatccactttggccgccaggcggcgcgcggcggcttcccggtgctactgtgcggcgaagagggggtcgggaaagagctgctgagccaggctattcacaatgaaagcgaacgggcgggcggcccctacatctccgtcaactgccagctatatgccgacagcgtgctgggccaggactttatgggcagcgcccctaccgacgatgaaaatggtcgcctgagccgccttgagctggccaacggcggcaccctgtttctggaaaagatcgagtatctggcgccggagctgcagtcggctctgctgcaggtgattaagcagggcgtgctcacccgcctcgacgcccggcgcctgatcccggtggatgtgaaggtgattgccaccaccaccgtcgatctggccaatctggtggaacagaaccgctttagccgccagctgtactatgcgctgcactcctttgagatcgtcatcccgccgctgcgcgcccgacgcaacagtattccgtcgctggtgcataaccggttgaagagcctggagaagcgtttctcttcgcgactgaaagtggacgatgacgcgctggcacagctggtggcctactcgtggccggggaatgattttgagctcaacagcgtcattgagaatatcgccatcagcagcgacaacggccacattcgcctgagtaatctgccggaatatctcttttccgagcggccgggcggggatagcgcgtcatcgctgctgccggccagcctgacttttagcgccatcgaaaaggaagctattattcacgccgcccgggtgaccagcgggcgggtgcaggagatgtcgcagctgctcaatatcggccgcaccaccctgtggcgcaaaatgaagcagtacgatattgacgccagccagttcaagcgcaagcatcaggcctagtctcttcgattcgcgccatggagaacagggcatccgacaggcgattgctgtagcgtttgagcgcgtcgcgcagcggatgcgcgcggtccatggccgtcagcaggcgttcgagccgacgggactgggtgcgcgccacgtgcagctgggcagaggcgagattcctccccgggatcacgaactgttttaacgggccgctctcggccatattgcggtcgataagccgctccagggcggtgatctcctcttcgccgatcgtctggctcaggcgggtcaggccccgcgcatcgctggccagttcagcccccagcacgaacagcgtctgctgaatatggtgcaggctttcccgcagcccggcgtcgcgggtcgtggcgtagcagacgcccagctgggatatcagttcatcgacggtgccgtaggcctcgacgcgaatatggtctttctcgatgcggctgccgccgtacagggcggtggtgcctttatccccggtgcgggtatagatacgatacattcagtttctctcacttaacggcaggactttaaccagctgcccggcgttggcgccgagcgtacgcagttgatcgtcgctatcggtgacgtgtccggtagccagcggcgcgtccgccggcagctgggcatgagtgagggctatctcgccggacgcgctgagcccgatacccacccgcaggggcgagcttctggccgccagggcgcccagcgcagcggcgtcaccgcctccgtcataggttatggtctggcaggggaccccctgctcctccagcccccagcacagctcattgatggcgccggcatggtgcccgcgcggatcgtaaaacaggcgtacgcctggcggtgaaagcgacatgacggtcccctcgttaacactcagaatgcctggcggaaaatcgcggcaatctcctgctcgttgcctttacgcgggttcgagaacgcattgccgtcttttagagccatctccgccatgtaggggaagtcggcctcttttacccccagatcgcgcagatgctgcggaataccgatatccatcgacagacgcgtgatagcggcgatggctttttccgccgcgtcgagagtggacagtccggtgatattttcgcccatcagttcagcgatatcggcgaatttctccgggttggcgatcaggttgtagcgcgccacatgcggcagcaggacagcgttggccacgccgtgcggcatgtcgtacaggccgcccagctggtgcgccatggcgtgcacgtagccgaggttggcgttattgaaagccatcccggccagcagagaagcataggccatgttttcccgcgcctgcagattgctgccgagggccacggcctggcgcaggttgcgggcgatgaggcggatcgcctgcatggcggcggcgtccgtcaccgggttagcgtctttggagatataggcctctacggcgtgggtcagggcatccatcccggtcgccgcggtcagggcggccggtttaccgatcatcagcagtggatcgttgatagagaccgacggcagtttgcgccagctgacgatcacaaacttcactttggtttcggtgttggtcaggacgcagtggcgggtgacctcgctggcggtgccggcggtggtattgaccgcgacgataggcggcagcgggttggtcagggtctcgattccggcatactggtacagatcgccctcatgggtggcggcgatgccgatgcctttgccgcaatcgtgcgggctgccgccgcccacggtgacgatgatgtcgcactgttcgcggcgaaacacggcgaggccgtcgcgcacgttggtgtctttcgggttcggctcgacgccgtcaaagatcgccacctcgatcccggcctcccgcagataatgcagggttttgtccaccgcgccatctttaattgcccgcaggcctttgtcggtgaccagcagggcttttttcccccccagcagctggcagcgttcgccgactacggaaatggcgttggggccaaaaaagttaacgtttggcaccagataatcaaacatacgatagctcataatataccttctcgcttcaggttataatgcggaaaaacaatccagggcgcactgggctaataattgatcctgctcgaccgtaccgccgctaacgccgacggcgccaattacctgctcattaaaaataactggcaggccgccgccaaaaataataattcgctgttggttggttagctgcagaccgtacagagattgtcctggctggaccgctgacgtaatttcatgggtaccttgcttcaggctgcaggcgctccaggctttattcagggaaatatcgcagctggagacgaaggcctcgtccatccgctggataagcagcgtgttgcctccgcggtcaactacggaaaacaccaccgccacgttgatctcagtggcttttttttccaccgccgccgccatttgctgggcggcggccagggtgattgtctgaacttgttggctcttgttcatcattctctcccgcaccaggataacgctggcgcgaatagtcagtagggggcgatagtaaaaaactattaccattcggttggcttgctttatttttgtcagcgttattttgtcgcccgccatgatttagtcaatagggttaaaatagcgtcggaaaaacgtaattaagggcgttttttattaattgatttatatcattgcgggcgatcacattttttatttttgccgccggagtaaagtttcatagtgaaactgtcggtagatttcgtgtgccaaattgaaacgaaattaaatttatttttttcaccactggctcatttaaagttccgctattgccggtaatggccgggcggcaacgacgctggcccggcgtattcgctaccgtctgcggatttcaccttttgagccgatgaacaatgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaagcggaggtcagcatgccgttaatagccgggattgatatcggcaacgccaccaccgaggtggcgctggcgtccgactacccgcaggcgagggcgtttgttgccagcgggatcgtcgcgacgacgggcatgaaagggacgcgggacaatatcgccgggaccctcgccgcgctggagcaggccctggcgaaaacaccgtggtcgatgagcgatgtctctcgcatctatcttaacgaagccgcgccggtgattggcgatgtggcgatggagaccatcaccgagaccattatcaccgaatcgaccatgatcggtcataacccgcagacgccgggcggggtgggcgttggcgtggggacgactatcgccctcgggcggctggcgacgctgccggcggcgcagtatgccgaggggtggatcgtactgattgacgacgccgtcgatttccttgacgccgtgtggtggctcaatgaggcgctcgaccgggggatcaacgtggtggcggcgatcctcaaaaaggacgacggcgtgctggtgaacaaccgcctgcgtaaaaccctgccggtggtggatgaagtgacgctgctggagcaggtccccgagggggtaatggcggcggtggaagtggccgcgccgggccaggtggtgcggatcctgtcgaatccctacgggatcgccaccttcttcgggctaagcccggaagagacccaggccatcgtccccatcgcccgcgccctgattggcaaccgttccgcggtggtgctcaagaccccgcagggggatgtgcagtcgcgggtgatcccggcgggcaacctctacattagcggcgaaaagcgccgcggagaggccgatgtcgccgagggcgcggaagccatcatgcaggcgatgagcgcctgcgctccggtacgcgacatccgcggcgaaccgggcacccacgccggcggcatgcttgagcgggtgcgcaaggtaatggcgtccctgaccggccatgagatgagcgcgatatacatccaggatctgctggcggtggatacgtttattccgcgcaaggtgcagggcgggatggccggcgagtgcgccatggagaatgccgtcgggatggcggcgatggtgaaagcggatcgtctgcaaatgcaggttatcgcccgcgaactgagcgcccgactgcagaccgaggtggtggtgggcggcgtggaggccaacatggccatcgccggggcgttaaccactcccggctgtgcggcgccgctggcgatcctcgacctcggcgccggctcgacggatgcggcgatcgtcaacgcggaggggcagataacggcggtccatctcgccggggcggggaatatggtcagcctgttgattaaaaccgagctgggcctcgaggatctttcgctggcggaagcgataaaaaaatacccgctggccaaagtggaaagcctgttcagtattcgtcacgagaatggcgcggtggagttctttcgggaagccctcagcccggcggtgttcgccaaagtggtgtacatcaaggagggcgaactggtgccgatcgataacgccagcccgctggaaaaaattcgtctcgtgcgccggcaggcgaaagagaaagtgtttgtcaccaactgcctgcgcgcgctgcgccaggtctcacccggcggttccattcgcgatatcgcctttgtggtgctggtgggcggctcatcgctggactttgagatcccgcagcttatcacggaagccttgtcgcactatggcgtggtcgccgggcagggcaatattcggggaacagaagggccgcgcaatgcggtcgccaccgggctgctactggccggtcaggcgaattaaacgggcgctcgcgccagcctctctctttaacgtgctatttcaggatgccgataatgaaccagacttctaccttaaccgggcagtgcgtggccgagtttcttggcaccggattgctcattttcttcggcgcgggctgcgtcgctgcgctgcgggtcgccggggccagctttggtcagtgggagatcagtattatctggggccttggcgtcgccatggccatctacctgacggccggtgtctccggcgcgcacctaaatccggcggtgaccattgccctgtggctgttcgcctgttttgaacgccgcaaggtgctgccgtttattgttgcccagacggccggggccttctgcgccgccgcgctggtgtatgggctctatcgccagctgtttctcgatcttgaacagagtcagcatatcgtgcgcggcactgccgccagtcttaacctggccggggtcttttccacgtacccgcatccacatatcacttttatacaagcgtttgccgtggagaccaccatcacggcaatcctgatggcgatgatcatggccctgaccgacgacggcaacggaattc

SEQ ID NO: 33 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 34 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 35 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 36 - DNA, 24 bp, Artificial Sequence
  Primer DHA-F1
gacggtatcgataagcttaaggag

SEQ ID NO: 37 - DNA, 24 bp, Artificial Sequence
  Primer DHA-R1
ggtggcggccgctctagattagct

SEQ ID NO: 38 - DNA, 24 bp, Artificial Sequence
  Primer DHA-R2
gaatgcgcaccacccgggcgtgaa

SEQ ID NO: 39 - DNA, 33 bp, Artificial Sequence
  Primer pGD20RM-F1
gaagatgcgtgcccgcaggaccccctccaacca

SEQ ID NO: 40 - DNA, 33 bp, Artificial Sequence
  Primer pGD20RM-R1
tggttggagggggtcctgcgggcacgcatcttc

SEQ ID NO: 41 - DNA, 36 bp, Artificial Sequence
  Primer TB4BF
gagctgggcatgcgtgggttaaccagctacgccgag

SEQ ID NO: 42 - DNA, 36 bp, Artificial Sequence
  Primer TB4BR
ctcggcgtagctggttaacccacgcatgcccagctc

SEQ ID NO: 43 - DNA, 33 bp, Artificial Sequence
  Primer pGD20RM-F2
actcggatattcgccggaccgcgcgcaccctga

SEQ ID NO: 44 - DNA, 33 bp, Artificial Sequence
  Primer pGD20RM-R2
tcagggtgcgcgcggtccggcgaatatccgagt

SEQ ID NO: 45 - DNA, 63 bp, Artificial Sequence
  Primer pGD20RM-F3
gcccgcaggaccccctccaaccagtgccacgtcaccaatctcaaagataatccggtgcagatt

SEQ ID NO: 46 - DNA, 61 bp, Artificial Sequence
  Primer TB4B-R1
gcgtgggttaaccagctacgccgagacggtgtcggtctacggcaccgaagcggtatttacc

SEQ ID NO: 47 - DNA, 72 bp, Artificial Sequence
  Primer pGD20RM-R4
ggtgcgcgcggtgcggcgaatatccgagtgggagaaagtctggtcgttggcggacgccacttcgaggtcgag

SEQ ID NO: 48 - protein, 6 aa, Artificial Sequence
  Fusion protein linker in clone Sma3002
QGGIPV

SEQ ID NO: 49 - protein, 6 aa, Artificial Sequence
  Fusion protein linker in clone Xba3009
EGGIPV

SEQ ID NO: 50 - DNA, 27 bp, Artificial Sequence
  Primer 1-E1-F1
gacaccattgaacaaggcggtattcct

SEQ ID NO: 51 - DNA, 27 bp, Artificial Sequence
  Primer 1-E1-R1
aggaataccgccttgttcaatggtgtc

SEQ ID NO: 52 - DNA, 33 bp, Artificial Sequence
  Primer 22-G7-F1
cccgacaccattgaagaaggcggtattcctgtg

SEQ ID NO: 53 - DNA, 33 bp, Artificial Sequence
  Primer 22-G7-R1
cacaggaataccgccttcttcaatggtgtcggg

SEQ ID NO: 54 - DNA, 27 bp, Artificial Sequence
  Primer 8-C9-F1
gcgctgatgggctattcggagagcaag

SEQ ID NO: 55 - DNA, 27 bp, Artificial Sequence
  Primer 8-C9-R1
cttgctctccgaatagcccatcagcgc

SEQ ID NO: 56 - DNA, 27 bp, Artificial Sequence
  Primer 9-D7-F1
gtcaccggcgattacctgcagacctcg

SEQ ID NO: 57 - DNA, 27 bp, Artificial Sequence
  Primer 9-D7-R1
cgaggtctgcaggtaatcgccggtgac

SEQ ID NO: 58 - DNA, 34 bp, Artificial Sequence
  Primer 10-G6-F1
ggcggtattcctgtgcaacagacaacccaaattc

SEQ ID NO: 59 - DNA, 34 bp, Artificial Sequence
  Primer 10-G6-R1
gaatttgggttgtctgttgcacaggaataccgcc

SEQ ID NO: 60 - DNA, 33 bp, Artificial Sequence
  Primer T53-SM-for
  misc_feature (18)..(20): n is a, c, g, or t
tgcggatctcccgccagnnncttgagtaccagg

SEQ ID NO: 61 - DNA, 39 bp, Artificial Sequence
  Primer L509-SM-for
  misc_feature (19)..(21): n is a, c, g, or t
ctgcagacctcggccattnnngatcggcagttcgaggtg

SEQ ID NO: 62 - DNA, 33 bp, Artificial Sequence
  Primer V224-SM-for
  misc_feature (16)..(18): n is a, c, g, or t
agctacgccgagacgnnntcggtctacggcacc

SEQ ID NO: 63 - DNA, 48 bp, Artificial Sequence
  Primer GDHM-F1
tttcaagctataccaagcatacaatgaaagcttaaggaggttaattaa

SEQ ID NO: 64 - DNA, 23 bp, Artificial Sequence
  Primer GDHM-R1
ctagattagcttcctttacgcag

SEQ ID NO: 65 - DNA, 23 bp, Artificial Sequence
  Primer GDHM-F2
agcttaaggaggttaattaaatg

SEQ ID NO: 66 - DNA, 46 bp, Artificial Sequence
  Primer GDHM-R2
gaggctagttattgctcagcggtctagattagcttcctttacgcag

SEQ ID NO: 67 - DNA, 2693 bp, Klebsiella pneumoniae
  CDS (1)..(1668): alpha subunit (DhaB1)
  CDS (1681)..(2265): beta subunit (DhaB2)
  CDS (2268)..(2693): gamma subunit (DhaB3)
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 68 - protein, 555 aa, Klebsiella pneumoniae; identical to SEQ ID NO: 33

SEQ ID NO: 69 - protein, 194 aa, Klebsiella pneumoniae; identical to SEQ ID NO: 34

SEQ ID NO: 70 - protein, 141 aa, Klebsiella pneumoniae; identical to SEQ ID NO: 35

SEQ ID NO: 71 - DNA, 2693 bp, Klebsiella pneumoniae
  CDS (1)..(1668): alpha subunit
  misc_feature (1)..(2693): Xba3007
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccaggcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 72 - protein, 555 aa, Klebsiella pneumoniae; identical to SEQ ID NO: 33

SEQ ID NO: 73 - protein, 194 aa, Klebsiella pneumoniae; identical to SEQ ID NO: 34

SEQ ID NO: 74 - protein, 141 aa, Klebsiella pneumoniae
MSEKTMRVQDYPLATRCPEHILTPTGKPLTDITLEKVLSGEVGPQDVRISRQALEYQAQIAEQMQRHAVARNFRRAAELIAIPDERILAIYNALRPFRSSQAELLAIADELEHTWHATVNAAFVRESAEVYQQRHKLRKGS

SEQ ID NO: 75 - DNA, 2693 bp, Klebsiella pneumoniae
  CDS (1)..(1668): alpha subunit
  misc_feature (1)..(2693): Xba3029
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattttcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 76 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAIFDRQFEVVSAVNDINDYQGPGTGYRISAERWAEIKNIPGVVQPDTIE

SEQ ID NO: 77 - protein, 194 aa, Klebsiella pneumoniae; identical to SEQ ID NO: 34

SEQ ID NO: 78 - protein, 141 aa, Klebsiella pneumoniae; identical to SEQ ID NO: 35

SEQ ID NO: 79 - DNA, 2693 bp, Klebsiella pneumoniae
  CDS (1)..(1668): alpha subunit
  misc_feature (1)..(2693): Xba3025
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggacctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 80 - protein, 555 aa, Klebsiella pneumoniae; identical to SEQ ID NO: 33

SEQ ID NO: 81 - protein, 194 aa, Klebsiella pneumoniae; identical to SEQ ID NO: 34

SEQ ID NO: 82 - protein, 141 aa, Klebsiella pneumoniae
MSEKTMRVQDYPLATRCPEHILTPTGKPLTDITLEKVLSGEVGPQDVRTSRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 83 - DNA, 2693 bp, Klebsiella pneumoniae
  CDS (1)..(1668): alpha subunit
  misc_feature (1)..(2693): Xba3015
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggctcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgccgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgtctttgtccgggagtcggtggaagtgtatcagcagcggcataagctgcgtaaaggaagctaa

SEQ ID NO: 84 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVAQPDTIE

SEQ ID NO: 85 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLPPLSNLELFSQAPLLTLETYRQIGKNAARYARKESPSPVPVVNDQMVRPKFMAKAALFHIKETKHVVQDAEPVTLHIDLVRE

SEQ ID NO: 86 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARNFRRAAELIAIPDERILAIYNALRPFRSSQAELLAIADELEHTWHATVNAVFVRESVEVYQQRHKLRKGS

SEQ ID NO: 87 - DNA, 2693 bp, Klebsiella pneumoniae
  CDS (1)..(1668): alpha subunit
  misc_feature (1)..(2693): Xba3008
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccagagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 88 - protein, 555 aa, Klebsiella pneumoniae; identical to SEQ ID NO: 33

SEQ ID NO: 89 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMARAALFHIKETKHVVQDAEPVTLHIDLVRE

SEQ ID NO: 90 - protein, 141 aa, Klebsiella pneumoniae; identical to SEQ ID NO: 35

SEQ ID NO: 91 - DNA, 2693 bp, Klebsiella pneumoniae
  CDS (1)..(1668): alpha subunit
  misc_feature (1)..(2693): Xba3016
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagaccattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 92 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREETIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 93 - protein, 194 aa, Klebsiella pneumoniae; identical to SEQ ID NO: 34

SEQ ID NO: 94 - protein, 141 aa, Klebsiella pneumoniae; identical to SEQ ID NO: 35

SEQ ID NO: 95 - DNA, 2693 bp, Klebsiella pneumoniae
  CDS (1)..(1668): alpha subunit
  misc_feature (1)..(2693): Xba3020
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgacggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 96 - protein, 555 aa, Klebsiella pneumoniae; identical to SEQ ID NO: 33

SEQ ID NO: 97 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVTVVNDQMVRPKFMAKAALFHIKETKHVVQDAEPVTLHIDLVRE

SEQ ID NO: 98 - protein, 141 aa, Klebsiella pneumoniae; identical to SEQ ID NO: 35

SEQ ID NO: 99 - DNA, 2693 bp, Klebsiella pneumoniae
  CDS (1)..(1668): alpha subunit
  misc_feature (1)..(2693): Xba3010
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgttggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaatgagatgccgccgcgtaacgtggtggaggatctgagtgcggtggaagagatgatgaagcgcaacatcaccggcctcgatattgtcggcgcgctgagccgcagcggctttgaggatatcgccagcagtattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgctccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 100 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASSILNMLRQRVTGDYLQTSAILDRQFEVVSAVNDINDYQGPGTGYRISAERWAEIKNIPGVVQPDTIE

SEQ ID NO: 101 - protein, 194 aa, Klebsiella pneumoniae
VQQTTQIQPSFTLKTREGGVASADERSDEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 102 - protein, 141 aa, Klebsiella pneumoniae; identical to SEQ ID NO: 35

SEQ ID NO: 103 - DNA, 2693 bp, Klebsiella pneumoniae
  CDS (1)..(1668): alpha subunit
  misc_feature (1)..(2693): Xba3023
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcatgtcagccgggaggaggtcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggagttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggtggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 104 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEVIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 105 - protein, 194 aa, Klebsiella pneumoniae; identical to SEQ ID NO: 34

SEQ ID NO: 106 - protein, 141 aa, Klebsiella pneumoniae; identical to SEQ ID NO: 35

SEQ ID NO: 107 - DNA, 2693 bp, Klebsiella pneumoniae
  CDS (1)..(2265): alpha-beta subunit fusion
  misc_feature (1)..(2693): Xba3009
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcgcagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagagcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaagaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcagagagctgattgccggggtggaagaagaggggcttcacgcccgggtggtgcgcattctgcgcacgtccgacgtctcctttatggcctgggatgcggctaacctgagcggctcggggatcggcatcggtatccagtcgaaggggaccacggtcatccatcagcgcgaactgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgctatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcactcctggcatgcgacagtgaatgccgcctttgtccgggagtcggcggaagtgtatcagcagcggcataagctgcgtaaaggaagctaa

SEQ ID NO: 108 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERAEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQSGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEEGGIPVQQTTQIQPSFTLKTREGGVASADERADEVVIGVGPAFDKHQHHTLIDMPHGAILRELIAGVEEEGLHARVVRILRTSDVSFMAWDAANLSGSGIGIGIQSKGTTVIHQRELLPLSNLELFSQAPLLTLETYRQIGKNAARYARKESPSPVPVVNDQMVRPKFMAKAALFHIKETKHVVQDAEPVTLHIDLVRE

SEQ ID NO: 109 - protein, 141 aa, Klebsiella pneumoniae
MSEKTMRVQDYPLATRCPEHILTPTGKPLTDITLEKVLSGEVGPQDVRISRQTLEYQAQIAEQMQRYAVARNFRRAAELIAIPDERILAIYNALRPFRSSQAELLAIADELEHSWHATVNAAFVRESAEVYQQRHKLRKGS

SEQ ID NO: 110 - DNA, 2693 bp, Klebsiella pneumoniae
  CDS (1)..(2265): alpha-beta subunit fusion
  misc_feature (1)..(2693): Sma3002
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 111 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 112 - protein, 141 aa, Klebsiella pneumoniae; identical to SEQ ID NO: 35

SEQ ID NO: 113 - DNA, 2693 bp, Klebsiella pneumoniae
  CDS (1)..(1668): alpha subunit
  misc_feature (1)..(2693): Sma3003
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacctgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 114 - protein, 555 aa, Klebsiella pneumoniae
MKRSKRFAVLAQRPVNQDGLIGEWPEEGLIAMDSPFDPVSSVKVDNGLIVELDGKRRDQFDLIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 115 - protein, 194 aa, Klebsiella pneumoniae; identical to SEQ ID NO: 34

SEQ ID NO: 116 - protein, 141 aa, Klebsiella pneumoniae; identical to SEQ ID NO: 35

SEQ ID NO: 117 - DNA, 2693 bp, Klebsiella pneumoniae
  CDS (1)..(1668): alpha subunit
  misc_feature (1)..(2693): Sma3009
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacgtggtcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcagagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 118 - protein, 555 aa, Klebsiella pneumoniae
MKRSKRFAVLAQRPVNQDGLIGEWPEEGLIAMDSPFDPVSSVKVDNGLIVELDGKRRDQFDVVDRFIADYAINVERTEQAMRLEAVEIARMLVDIHVSREEIIAITTAITPAKAVEVMAQMNVVEMMMALQKMRARRTPSNQCHVTNLRDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 119 - protein, 194 aa, Klebsiella pneumoniae; identical to SEQ ID NO: 34

SEQ ID NO: 120 - protein, 141 aa, Klebsiella pneumoniae; identical to SEQ ID NO: 35

SEQ ID NO: 121 - DNA, 2693 bp, Klebsiella pneumoniae
  CDS (1)..(1668): alpha subunit
  misc_feature (1)..(2693): Sma3010
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacgtgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgtgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 122 - protein, 555 aa, Klebsiella pneumoniae
MKRSKRFAVLAQRPVNQDGLIGEWPEEGLIAMDSPFDPVSSVKVDNGLIVELDGKRRDQFDVIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 123 - protein, 194 aa, Klebsiella pneumoniae
VQQTTQIQPSFTLKTREGGVASADERADEVVIGVGPAFDKHQHHTLIDMPHGVILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 124 - protein, 141 aa, Klebsiella pneumoniae; identical to SEQ ID NO: 35

SEQ ID NO: 125 - DNA, 2693 bp, Klebsiella pneumoniae
  CDS (1)..(1668): alpha subunit
  misc_feature (1)..(2693): Sma3008
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacacgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctaatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 126 - protein, 555 aa, Klebsiella pneumoniae
MKRSKRFAVLAQRPVNQDGLIGEWPEEGLIAMDSPFDPVSSVKVDNGLIVELDGKRRDQFDTIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 127 - protein, 194 aa, Klebsiella pneumoniae; identical to SEQ ID NO: 34

SEQ ID NO: 128 - protein, 141 aa, Klebsiella pneumoniae; identical to SEQ ID NO: 35

SEQ ID NO: 129 - DNA, 2693 bp, Klebsiella pneumoniae
  CDS (1)..(1668): alpha subunit
  misc_feature (1)..(2693): PpuMI002
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgcaggaccccctccaaccagtgccacgtcaccaatctcaaacataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 130 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKHNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 131 - protein, 194 aa, Klebsiella pneumoniae; identical to SEQ ID NO: 34

SEQ ID NO: 132 - protein, 141 aa, Klebsiella pneumoniae; identical to SEQ ID NO: 35

SEQ ID NO: 133 - DNA, 2693 bp, Klebsiella pneumoniae
  CDS (1)..(1668): alpha subunit
  misc_feature (1)..(2693): RsrII001
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactgtctcccactcggatattcgccggaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 134 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTVSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 135 - protein, 194 aa, Klebsiella pneumoniae; identical to SEQ ID NO: 34

SEQ ID NO: 136 - protein, 141 aa, Klebsiella pneumoniae; identical to SEQ ID NO: 35

SEQ ID NO: 137 - DNA, 2693 bp, Klebsiella pneumoniae
  CDS (1)..(1668): alpha subunit
  misc_feature (1)..(2693): 4BR1001
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgctgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 138 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 139 - protein, 194 aa, Klebsiella pneumoniae; identical to SEQ ID NO: 34

SEQ ID NO: 140 - protein, 141 aa, Klebsiella pneumoniae; identical to SEQ ID NO: 35

SEQ ID NO: 141 - DNA, 2693 bp, Klebsiella pneumoniae
  CDS (1)..(1668): alpha subunit
  misc_feature (1)..(2693): KG005
  CDS (1681)..(2265): beta subunit
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattaccaaaggcgccggggttcagggactgcaaaacggcgcggtgagctgtatcggcttgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgtcggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 142 - protein, 555 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGLTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 143 - protein, 194 aa, Klebsiella pneumoniae
VQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVSVVNDQMVRPKFMAKAALFHIKETKHVVQDAEPVTLHIDLVRE

SEQ ID NO: 144 - protein, 141 aa, Klebsiella pneumoniae; identical to SEQ ID NO: 35

SEQ ID NO: 145 - DNA, 2693 bp, Klebsiella pneumoniae
  CDS (1)..(2265): alpha-beta subunit fusion
  misc_feature (1)..(2693): 1-E1
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 146 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 147 - protein, 141 aa, Klebsiella pneumoniae; identical to SEQ ID NO: 35

SEQ ID NO: 148 - DNA, 2693 bp, Klebsiella pneumoniae
  CDS (1)..(2265): alpha-beta subunit fusion
  misc_feature (1)..(2693): 22-G7
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaagaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 149 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEEGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 150 - protein, 141 aa, Klebsiella pneumoniae; identical to SEQ ID NO: 35

SEQ ID NO: 151 - DNA, 2693 bp, Klebsiella pneumoniae
  CDS (1)..(2265): alpha-beta subunit fusion
  misc_feature (1)..(2693): 8-C9
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 152 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 153 - protein, 141 aa, Klebsiella pneumoniae; identical to SEQ ID NO: 35

SEQ ID NO: 154 - DNA, 2693 bp, Klebsiella pneumoniae
  CDS (1)..(2265): alpha-beta subunit fusion
  misc_feature (1)..(2693): 9-D7
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 155 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 156 - protein, 141 aa, Klebsiella pneumoniae; identical to SEQ ID NO: 35

SEQ ID NO: 157 - DNA, 2693 bp, Klebsiella pneumoniae
  CDS (1)..(2265): alpha-beta subunit fusion
  misc_feature (1)..(2693): 10-G6
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctgttcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 158 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGCSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 159 - protein, 141 aa, Klebsiella pneumoniae; identical to SEQ ID NO: 35

SEQ ID NO: 160 - DNA, 2693 bp, Klebsiella pneumoniae
  CDS (1)..(2265): alpha-beta subunit fusion
  misc_feature (1)..(2693): GDH-SM1-G11
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagtcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 161 - protein, 754 aa, Klebsiella pneumoniae; identical to SEQ ID NO: 146

SEQ ID NO: 162 - protein, 141 aa, Klebsiella pneumoniae
MSEKTMRVQDYPLATRCPEHILTPTGKPLTDITLEKVLSGEVGPQDVRISRQSLEYQAQIAEQMQRHAVARNFRRAAELIAIPDERILAIYNALRPFRSSQAELLAIADELEHTWHATVNAAFVRESAEVYQQRHKLRKGS

SEQ ID NO: 163 - DNA, 2693 bp, Klebsiella pneumoniae
  CDS (1)..(2265): alpha-beta subunit fusion
  misc_feature (1)..(2693): GDH-SM2-B11
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccatttttgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 164 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAIFDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 165 - protein, 141 aa, Klebsiella pneumoniae; identical to SEQ ID NO: 35

SEQ ID NO: 166 - DNA, 2693 bp, Klebsiella pneumoniae
  CDS (1)..(2265): alpha-beta subunit fusion
  misc_feature (1)..(2693): GDH-SM3-D2
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 167 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 168 - protein, 141 aa, Klebsiella pneumoniae; identical to SEQ ID NO: 35

SEQ ID NO: 169 - DNA, 2693 bp, Klebsiella pneumoniae
  CDS (1)..(2265): alpha-beta subunit fusion
  misc_feature (1)..(2693): GDH-SM4-H2
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagtgtcttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 170 - protein, 754 aa, Klebsiella pneumoniae; identical to SEQ ID NO: 146

SEQ ID NO: 171 - protein, 141 aa, Klebsiella pneumoniae
MSEKTMRVQDYPLATRCPEHILTPTGKPLTDITLEKVLSGEVGPQDVRISRQCLEYQAQIAEQMQRHAVARNFRRAAELIAIPDERILAIYNALRPFRSSQAELLAIADELEHTWHATVNAAFVRESAEVYQQRHKLRKGS

SEQ ID NO: 172 - DNA, 2693 bp, Klebsiella pneumoniae
  CDS (1)..(2265): alpha-beta subunit fusion
  misc_feature (1)..(2693): SHGDH37
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcaagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 173 - protein, 754 aa, Klebsiella pneumoniae; identical to SEQ ID NO: 167

SEQ ID NO: 174 - protein, 141 aa, Klebsiella pneumoniae
MSEKTMRVQDYPLATRCPEHILTPTGKPLTDITLKKVLSGEVGPQDVRISRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 175 - DNA, 2693 bp, Klebsiella pneumoniae
  CDS (1)..(2265): alpha-beta subunit fusion
  misc_feature (1)..(2693): SHGDH51
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactgtctcccactcggatattcgccggaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcctgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccaggcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 176 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTVSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 177 - protein, 141 aa, Klebsiella pneumoniae; identical to SEQ ID NO: 74

SEQ ID NO: 178 - DNA, 2693 bp, Klebsiella pneumoniae
  CDS (1)..(2265): alpha-beta subunit fusion
  misc_feature (1)..(2693): SHGDH12
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacattgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgtgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgagaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 179 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINIERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLRTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 180 - protein, 141 aa, Klebsiella pneumoniae; identical to SEQ ID NO: 35

SEQ ID NO: 181 - DNA, 2693 bp, Klebsiella pneumoniae
  CDS (1)..(2265): alpha-beta subunit fusion
  misc_feature (1)..(2693): SHGDH22
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccaaactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatggcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcataccctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctacgtaaaggaagctaa

SEQ ID NO: 182 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYGISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 183 - protein, 141 aa, Klebsiella pneumoniae
MSEKTMRVQDYPLATRCPEHTLTPTGKPLTDITLEKVLSGEVGPQDVRISRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 184 - DNA, 2693 bp, Klebsiella pneumoniae
  CDS (1)..(2265): alpha-beta subunit fusion
  misc_feature (1)..(2693): SHGDH38
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgatcacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcgacagacaacccaaattcagccctctttcaccctgaaaacccgcgagggcgaggtagcttctgccgatgaacgcgccgatgaagtggtgatcggcgtcggccctgccttcgataaacaccagcatcacactctgatcgatatgccccatggcgcgatcctcaaagagctgattgccggggtggaagaggaggggctccacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcagtttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 185 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDHLQTSAILDRQFEVVSAVNDINDYQGPGTGYRISAERWAEIKNIPGVVQPDTIEQGGIPVRQTTQIQPSFTLKTREGEVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 186 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARSFRRAAELIAIPDERILAIYNALRPFRSSQAELLAIADELEHTWHATVNAAFVRESAEVYQQRHKLRKGS

SEQ ID NO: 187 - DNA, 2693 bp, Klebsiella pneumoniae
  CDS (1)..(2265): alpha-beta subunit fusion
  misc_feature (1)..(2693): SHGDH24
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgcgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagtggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 188 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 189 - protein, 141 aa, Klebsiella pneumoniae; identical to SEQ ID NO: 35

SEQ ID NO: 190 - DNA, 2693 bp, Klebsiella pneumoniae
  CDS (1)..(2265): alpha-beta subunit fusion
  misc_feature (1)..(2693): SHGDH43
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggaaagcaagtcgatgctctacctcgaatcgcgctgcatcttcattactaaaggcgccggggttcagggactgcaaaacggcgcggtaagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccagagccgcgctatttcatatcgaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagtcccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 191 - protein, 754 aa, Klebsiella pneumoniae
MKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMARAALFHIEETKHVVQDAEPVTLHIDLVRE

SEQ ID NO: 192 - protein, 141 aa, Klebsiella pneumoniae; identical to SEQ ID NO: 162

SEQ ID NO: 193 - DNA, 2693 bp, Klebsiella pneumoniae
  CDS (1)..(2265): alpha-beta subunit fusion
  misc_feature (1)..(2693): SHGDH25
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacctgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggcggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtgggttaaccagctacgccgagacgttgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 194 - protein, 754 aa, Klebsiella pneumoniae
MKRSKRFAVLAQRPVNQDGLIGEWPEEGLIAMDSPFDPVSSVKVDNGLIVELDGKRRDQFDLIDRFIADYAINVERTEQAMRLEAVEIARMLVDIHVSREEIIAITTAITPAKAVEVMAQMNVAEMMMALQKMRARRTPSNQCHVTNLKDNPVQIAADAAEAGIRGFSEQETTVGIARYAPFNALALLVGSQCGRPGVLTQCSVEEATELELGMRGLTSYAETLSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPIADEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIEQGGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 195 - protein, 141 aa, Klebsiella pneumoniae; identical to SEQ ID NO: 35

SEQ ID NO: 196 - DNA, 2693 bp, Klebsiella pneumoniae
  CDS (1)..(2265): alpha-beta subunit fusion
  misc_feature (1)..(2693): SHGDH29
  CDS (2268)..(2693): gamma subunit
atgaaaagatctaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccgatttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcaccgaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattactaaaggcgccggggttcagggactgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgctggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccatttttgatcggcagttcgaggtggtgagtgcggtcaacgacatcaatgactatcaggggccgggcaccggctatcgcatctctgccgaacgctgggcggagatcaaaaatattccgggcgtggttcagcccgacacgattgaacaaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcgggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 197 - protein, 754 aa, Klebsiella pneumoniae; identical to SEQ ID NO: 164

SEQ ID NO: 198 - protein, 141 aa, Klebsiella pneumoniae
MSEKTMRVQDYPLATRCPEHILTPTGKPLTDITLEKVLSGEVGPQDVRISRQTLEYQAQIAEQMQRHAVARNFRRAAELIAIPDERILAIYNALRPFRSSRAELLAIADELEHTWHATVNAAFVRESAEVYQQRHKLRKGS

SEQ ID NO: 199 - DNA, 23 bp, Artificial Sequence
  Primer GD-C
gcggccgctctagattagcttcc

SEQ ID NO: 200 - DNA, 24 bp, Rhodosporidium glutinis
caagctataccaagcatacaatga

SEQ ID NO: 201 - DNA, 24 bp, Rhodosporidium glutinis
ctgcagctcgagggggggcccggt

SEQ ID NO: 202 - DNA, 21 bp, Rhodosporidium glutinis
tagctctagaatggcaccctc

SEQ ID NO: 203 - DNA, 19 bp, Rhodosporidium glutinis
ccgctgagcaataactagc

What is claimed is:

1. A method for the recombination of a double stranded first nucleic acid template and a double stranded second nucleic acid template wherein the method comprises:

a) providing the double-stranded first nucleic acid template with the second double-stranded nucleic acid template, wherein the first and the second double-stranded nucleic acid templates have at least 50% identity to each other, wherein the 5' end of the sense strand of the first nucleic acid template is of different sequence than the 5' end of the sense strand of the second nucleic acid template and the 3' end of the sense strand of the first nucleic acid template is of different sequence than the 3' end of the sense strand of the second nucleic acid template, and wherein each of the 5' ends and the 3' ends of the sense strands of the first and the second nucleic acid templates are between 6 to 200 nucleotides in length;

b) providing a forward primer that will only anneal to the 3' end of the antisense strand of the first nucleic acid template;

c) providing a reverse primer that will only anneal to the 3' end of the sense strand of the second nucleic acid template;

d) contacting the first and the second nucleic acid templates of (a) with the primers of (b) and (c) in a replication composition whereby a short, abbreviated primer directed extension of the primers is conducted;

e) terminating the extension of the primers of (d) after the addition of no more than about 1000 nucleotides;

f) separating the extended forward and reverse primers from the first and the second nucleic acid templates;

g) re-annealing the extended forward and reverse primers with the first and the second nucleic acid templates at low annealing temperatures whereby the extended primers anneal to either the first or the second nucleic acid template in a second replication composition whereby short, abbreviated primer-directed extension is conducted; and h) repeating steps (e)-(g) until at least one full-length extension product is generated comprising the recombination of the first and the second double stranded nucleic acid templates.

2. The method according to claim 1 wherein the first and the second nucleic acid templates have at least 70% identity to each other.

3. The method according to claim 1 wherein the first and the second nucleic acid templates have at least 90% identity to each other.

4. The method according to claim 1 wherein, prior to step (a), the first and the second nucleic acid templates are contacted with an enzyme under conditions whereby the templates are nicked.

5. The method according to claim 1 wherein either one or both of the first and the second nucleic acid templates are comprised on a plasmid.

6. A method for the recombination of a first nucleic acid antisense single-stranded template and a second nucleic acid sense single-stranded template wherein the method comprises:

a) providing the first antisense single-stranded nucleic acid template and the second sense single-stranded nucleic acid template wherein a complementary sense strand of the first antisense single-stranded nucleic acid template has at least 50% identity to the second sense single-stranded nucleic acid template;

b) providing a forward primer that will only anneal to the 3' end of the first nucleic acid template, wherein the 3' end of the first nucleic acid template is between 6 to 200 nucleotides in length;

c) providing a reverse primer that will only anneal to the 3' end of the second nucleic acid template, wherein the 3' end of the second nucleic acid template is between 6 to 200 nucleotides in length;

d) contacting the first and second nucleic acid templates of (a) with the primers of (b) and (c) in a replication composition whereby short, abbreviated primer directed extension of the primers is conducted;

e) terminating extension of the primers of (d) after the addition of no more than about 1000 nucleotides;

f) separating the extended forward and reverse primers from the first and the second nucleic acid templates;

g) re-annealing the extended forward and reverse primers with the first and the second nucleic acid templates at low annealing temperatures whereby the extended primers anneal to either the first or the second nucleic acid template whereby short, abbreviated primer-directed extension is conducted; and h) repeating steps (e)-(g) until at least one full-length extension product is generated comprising the recombination of the first and the second nucleic acid templates.

7. The method according to either of claim 1 or 6 wherein the length of the first and the second nucleic acid templates is from about 0.03 kB to about 20 kB.

8. The method according to either of claim 1 or 6 wherein the primer extension of step (d), (g) and/or (h) is terminated after the addition of no more than about 500 nucleotides.

9. The method according to either of claim 1 or 6 wherein the primer extension of step (d), (g) and/or (h) is terminated after the addition of no more than about 300 nucleotides.

10. The method according to either of claim 1 or 6 wherein the primer extension of step (d), (g) and/or (h) is terminated after the addition of no more than about 20-50 nucleotides.

11. The method according to either of claim 1 or 6 wherein the termination step is selected from the group consisting of: altering the annealing temperature, altering the pH, and adding a polymerase inhibitor.

12. The method according to either of claim 1 or 6 wherein the 3' ends of the antisense strands of the first and second nucleic acid templates are engineered flanking regions.

13. The method according to either of claim 1 or 6 wherein the 3' ends of the sense strands of the first and second nucleic acid templates are engineered flanking regions.

14. The method according to either of claim 1 or 6 wherein the at least one full-length extension product is optionally purified from the first and the second nucleic acid templates.

15. The method according to either of claim 1 or 6 wherein the full-length extension product is optionally amplified.

16. The method according to either of claim 1 or 6, wherein the forward and reverse primers are from about 6 to about 200 nucleotides in length.

17. The method according to either of claim 1 or 6 wherein the primer directed extension is accomplished using a technique selected from the group consisting of polymerase chain reaction, ligase chain reaction and strand displacement amplification.

18. The method according to either of claim 1 or 6 wherein, prior to step (a), the first and the second nucleic acid templates are linear.

19. The method according to either of claim 1 or 6 wherein either one or both of the first and the second nucleic acid template are allelic variants.

20. The method according to either of claim 1 or 6 wherein the full-length extension product of (h) comprising the recombined first and the second templates is further subjected to steps (b)-(g).

21. The method according to either of claim 1 or 6 wherein the forward and reverse primers are of different sequence from one another.

22. The method according to either of claim 1 or 6 wherein the forward and reverse primers have the same sequence as one another.

23. The method according to either of claim 1 or 6 wherein:
a) the 3' end of the antisense strand of the first template comprises a first unique restriction site, and wherein the 3' end of the sense strand of the second template comprises a second unique restriction site wherein said first unique restriction site is not present in the second template and wherein the second unique restriction site is not present in said first template; and
b) wherein the full-length extension product comprises the first and the second unique restriction sites.

24. The method according to claim 23 further comprising:
a) restricting the full-length extension product with either one or both of a first restriction enzyme which cuts at said first unique restriction site and a second restriction enzyme which cuts at said second unique restriction site to generate a restricted full-length extension product; and
b) ligating said restricted full-length extension product into a vector.

25. A method for the generation of a recombined polypeptide having altered properties comprising:
a) providing a double-stranded first nucleic acid template encoding a first polypeptide with a second double-stranded nucleic acid template encoding a second polypeptide, wherein the first and the second double-stranded nucleic acid templates having at least 50% identity to each other, and wherein the 5' end of the sense strand of the first nucleic acid template is of different sequence than the 5' end of the sense strand of the second nucleic acid template and the 3' end of the sense strand of the first nucleic acid template is of different sequence than the 3' end of the sense strand of the second nucleic acid template, and wherein each of the 5' end and the 3' end of the sense strands of the first and the second nucleic acid templates are between 6 to 200 nucleotides in length;
b) providing a forward primer that will only anneal to the 3' end of the antisense strand of the first nucleic acid template;
c) providing a reverse primer that will only anneal to the 3' end of the sense strand of the second nucleic acid template
d) contacting the first and the second nucleic acid templates of (a) with the primers of (b) and (c) in a replication composition whereby short, abbreviated primer directed extension of the primers takes place is conducted;
e) terminating extension of the primers of (d) after the addition of no more than about 1000 nucleotides;
f) separating the extended forward and reverse primers from the first and the second nucleic acid templates;
g) re-annealing the extended forward and reverse primers with the first and the second templates at low annealing temperatures whereby the extended primers anneal to either the first or the nucleic second template whereby short, abbreviated primer-directed extension is conducted;
h) repeating steps (e)-(g) until at least one full-length extension product is generated comprising the recombination of the first and the second nucleic acid templates;
i) placing the full-length extension product under control of expression control sequences for expressing the full-length extension product of (h) to generate a recombined polypeptide; and
j) screening the recombined polypeptide of (i) for altered properties as compared with the polypeptide encoded by either the first or the second nucleic acid template; wherein the full length extension product encodes a polypeptide with properties altered from that of the polypeptide encoded by either the first or the second nucleic acid template.

26. The method according to claim 25 wherein the first and the second nucleic acid templates have at least 70% identity to each other.

27. The method according to claim 25 wherein the first and the second nucleic acid templates have at least 90% identity to each other.

28. A method for the generation of a recombined polypeptide having altered properties comprising:
a) providing a first antisense single-stranded nucleic acid template obtained from double stranded DNA encoding a first polypeptide, and a second sense single-stranded nucleic acid template, obtained from double stranded DNA encoding a second polypeptide wherein the double stranded DNA encoding the first and the second polypeptide have at least 50% identity to each other;
b) providing a forward primer that will only anneal to the 3' end of the first nucleic acid template, wherein the 3' end of the first nucleic acid template is between 6 to 200 nucleotides in length;
c) providing a reverse primer that will only anneal to the 3' end of the second nucleic acid template, wherein the 3' end of the second nucleic acid template is between 6 to 200 nucleotides in length;
d) contacting the first and the second nucleic acid templates of (a) with the primers of (b) and (c) in a replication composition whereby short, abbreviated primer directed extension of the primers is conducted;
e) terminating extension of the primers of (d) after the addition of no more than about 1000 nucleotides;
f) separating the extended forward and reverse primers from the first and the nucleic acid second templates;
g) re-annealing the extended forward and reverse primers with the first and the second templates at low annealing temperatures whereby the extended primers anneal to either the first or the nucleic acid second nucleic acid templates whereby short, abbreviated primer-directed extension is conducted;
h) repeating steps (e)-(g) until at least one full-length extension product is generated comprising the recombination of the first and the second nucleic acid templates;
i) placing the full-length extension product under control of expression control sequences for expressing the full-length extension product of (h) to generate a recombined polypeptide; and
j) screening the recombined polypeptide of (i) for altered properties as compared with the polypeptide encoded by either the first or the second double-stranded nucleic acid template; wherein the full length extension product encodes a polypeptide with properties altered from that of the polypeptide encoded by either the first or the second double stranded nucleic acid template.

29. The method according to either of claim 25 or 28 wherein the primer extension of step (d), (g) and/or (h) is terminated after the addition of no more than about 500 nucleotides.

30. The method according to either of claim 25 or 28 wherein the primer extension of step (d), (g) and/or (h) is terminated after the addition of no more than about 300 nucleotides.

31. The method according to either of claim 25 or 28 wherein the primer extension of step (d), (g) and/or (h) is terminated after the addition of no more than about 20-50 nucleotides.

32. The method according to either of claim 25 or 28 wherein the termination step is selected from the group consisting of: altering the annealing temperature, altering the pH, and adding a polymerase inhibitor.

33. The method according to either of claim 25 or 28 wherein the 3' end of either the first or the second nucleic acid template is from about 6 to about 200 bases in length.

34. The method according to either of claim 25 or 28 wherein the 3' ends of the antisense strands of the first and second nucleic acid templates are engineered flanking regions.

35. The method according to either of claim 25 or 28 wherein the 3' ends of the sense strands of the first and second nucleic acid templates are engineered flanking regions.

36. The method according to either of claim 25 or 28 wherein the forward and reverse primers are about 6-200 nucleotides in length.

37. The method according to either of claim 25 or 28 wherein the primer directed extension is accomplished using a technique selected from the group consisting of polymerase chain reaction, ligase chain reaction and strand displacement amplification.

38. The method according to either of claim 25 or 28 wherein the recombined polypeptide is an enzyme.

39. The method according to claim 38 wherein the enzyme is selected from the group consisting of: a protease, an esterase, a pectinase, a xylanase, amylase, a cellulase, a levanase, a lipase, a RNase, a nucleotidase, a transfructosylase, a lactase, a desaturases, a dehydrogenase, an oxidases, a transferases, an isomerases, a dehydratases, a desulfurases, a hydratases, a phosphatases, a kinases, a glucose isomerase phosphatase, a phenylalanine ammonia-lyase, a cinnamyl alcohol dehydrogenase, an o-methyltransferase, a cinnamate 4-hydroxylase, a 4-coumarate-CoA ligase, a cinnamoyl CoA reductase, and an acetolactate synthase.

40. The method according to claim 39 wherein the enzyme is a glycerol dehydratase.

41. The method according to claim 38 wherein the properties of the enzyme are screened with respect to properties selected from the group consisting of: enzyme activity, substrate specificity, stability against inhibitors, thermal stability, protease stability, solvent stability, detergent stability, and folding properties.

42. The method according to either of claim 25 or 28 wherein the recombined polypeptide is not an enzyme.

43. The method according to claim 42 wherein the recombined polypeptide is selected from the group consisting of cytokines, glycoproteins, growth factors, biotin binding proteins, immunoglobin binding proteins, structural proteins, viral proteins, envelope proteins and microbial antigens.

44. The method according to claim 42 wherein the properties of the polypeptide are screened with respect to properties selected from the group consisting of: thermal stability, protease stability, solvent stability, detergent stability, folding properties, structural properties.

45. A method for the recombination of nucleic acid templates of interest comprising:
   a) providing an antisense single-stranded first nucleic acid template and a sense single-stranded second nucleic acid template wherein a complementary sense strand of the first antisense single-stranded nucleic acid template has at least 50% identity to the second sense single-stranded nucleic acid template;
   b) providing a forward primer that will only anneal to the 3' end of the antisense strand of the first nucleic acid template wherein the 3' end of the antisense strand of the first nucleic acid template is between 6 to 200 nucleotides in length;
   c) providing a reverse primer that will only anneal to the 3' end of the sense strand of the second nucleic acid template wherein the 3' end of the sense strand of the second nucleic acid template is between 6 to 200 nucleotides in length;
   d) contacting the first and the second nucleic acid templates of (a) with the primers of (b) and (c) in a replication composition whereby short, abbreviated primer directed extension of the primers is conducted;
   e) terminating extension of the primers of (d) after the addition of no more than about 1000 nucleotides;
   f) separating the extended forward and reverse primers from the first and the second nucleic acid templates;
   g) re-annealing the extended forward and reverse primers with the first and the second nucleic acid templates at low annealing temperatures whereby the extended primers anneal to either the first or the second nucleic acid templates whereby short, abbreviated primer-directed extension is conducted; and
   h) repeating steps (e)-(g) until at least one full-length extension product is generated comprising the recombination of the first and the second single stranded nucleic acid templates.

* * * * *